United States Patent 12,565,641 (ENGINEERED TERMINAL DEOXYNUCLEOTIDYL TRANSFERASE VARIANTS) - sequence listing, part 2

SEQ ID NO: 2109 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgaggattacaagtttaaagagaacctgatcgcgtgtctggaagcccagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcgccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2110 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAEDYKFKENLIACLEAQRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTIAGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2111 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagcccagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2112 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAQRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2113 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcggtaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2114 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGGKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2115 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtgtgctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2116 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASVLKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2117 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2118 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2119 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcaggaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2120 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGRKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2121 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtaggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2122 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2123 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcggttaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2124 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2125 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccgggcgcgccgcgagtattctgaaatatctgccgttcgaagttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2126 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAGRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2127 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgacgatgttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2128 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDDVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2129 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagcccagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtaggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2130 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAQRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2131 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagtcgctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2132 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2133 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2134 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2135 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgttgttacggtgatcgtgaaggagacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2136 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADVVTVIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2137 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagaagatctttctgaaagcgggcagcgaagaagagattttcgcgcatctgggtctggattatgtggagccgtgggaacgcaacgcg

SEQ ID NO: 2138 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKKIFLKAGSEEEIFAHLGLDYVEPWERNA

SEQ ID NO: 2139 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2140 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2141 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacattgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2142 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2143 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggcttgccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2144 - protein, 394 aa, synthetic construct
  REGION 1..394: note = Variant of terminal deoxynucleotidyl transferase
MHHHHHHGDSGLPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2145 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaaggcgctgaagctgagcaagatgcagaaggcgggctttctgtattacgaggatctggcgagccgcgttagtaaagaagaagccgatgttgttacggtgatcgtgaagaatacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcgtacaatacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2146 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKALKLSKMQKAGFLYYEDLASRVSKEEADVVTVIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2147 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgaggattacaagtttaaagagaacctgatcgcgtgtctggaagcccagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2148 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAEDYKFKENLIACLEAQRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2149 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacattgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcggttaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2150 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKALKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2151 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2152 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2153 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcgtacaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2154 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2155 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2156 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2157 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgccgggccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacattgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcgtacaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2158 - protein, 394 aa, synthetic construct
  REGION 1..394: note = Variant of terminal deoxynucleotidyl transferase
MHHHHHHGDSGHPISNTPEGEVPSVIAGPVSQYSCQRKTTLNNYNKKFTDALEIMAESYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2159 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2160 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2161 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgtgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2162 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAVSILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2163 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2164 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2165 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcggtggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2166 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDAVEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2167 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgtctgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2168 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLSACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2169 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctggaggcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2170 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLEACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2171 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgttctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2172 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDVLEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2173 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaaatgaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcacatctgggtctggattatgtggagccgtgggaacgcaacgcg

SEQ ID NO: 2174 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEMKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2175 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtactggtatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2176 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYWYALLGWTGSKEFRRDLRRYAEEERGMILDNHALYDLKKRIFLKAGSEEEIFAHLGLDYVEPWERNA

SEQ ID NO: 2177 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttctcgcatctgggtctggattatgtggagccgtgggaacgcaacgcg

SEQ ID NO: 2178 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFSHLGLDYVEPWERNA

SEQ ID NO: 2179 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaaagtctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2180 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKSLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2181 - DNA, 1182 bp, synthetic construct
  misc_feature 1..1182: note = Variant of terminal deoxynucleotidyl transferase
  source 1..1182: mol_type = other DNA
atgcatcaccatcatcatcatggcgatagcttgcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2182 - protein, 394 aa, synthetic construct
  REGION 1..394: note = Variant of terminal deoxynucleotidyl transferase
MHHHHHHGDSLHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2183 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgctgacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2184 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVLTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2185 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgtgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2186 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDVLVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2187 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcacggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2188 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFTEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2189 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggaggatatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2190 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEDIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2191 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggaggttgaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2192 - protein, 394 aa, synthetic construct
  REGION 1..394: note = Variant of terminal deoxynucleotidyl transferase
MHHHHHHGGSGHPPSNTPEVEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2193 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaattggacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2194 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKLDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2195 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattatgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2196 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIMKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2197 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggagctggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2198 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAELERGMILDNHALYDLKKRIFLKAGSEEEIFAHLGLDYVEPWERNA

SEQ ID NO: 2199 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccctgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2200 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSPVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2201 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaaggctcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2202 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKAQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2203 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgggggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2204 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDAGEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2205 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagaggggttcgcgcatctgggtctggattatgtggagccgtgggaacgcaacgcg

SEQ ID NO: 2206 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEGFAHLGLDYVEPWERNA

SEQ ID NO: 2207 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2208 - protein, 394 aa, synthetic construct
  REGION 1..394: note = Variant of terminal deoxynucleotidyl transferase
MHHHHHHGGSGHPPSNTPEKEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2209 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccagtggagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2210 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPVEQYAYALLGWTGSKEFRRDLRRYAEEERGMILDNHALYDLKKRIFLKAGSEEEIFAHLGLDYVEPWERNA

SEQ ID NO: 2211 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgcctggtacgacctgaaaaagcgcatctttctgaaagcgggcagcgaagaagagattttcgcgcatctgggtctggattatgtggagccgtgggaacgcaacgcg

SEQ ID NO: 2212 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHAWYDLKKRIFLKAGSEEEIFAHLGLDYVEPWERNA

SEQ ID NO: 2213 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcgatgaagaagagattttcgcgcatctgggtctggattatgtggagccgtgggaacgcaacgcg

SEQ ID NO: 2214 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGDEEEIFAHLGLDYVEPWERNA

SEQ ID NO: 2215 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggaggaggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2216 - protein, 394 aa, synthetic construct
  REGION 1..394: note = Variant of terminal deoxynucleotidyl transferase
MHHHHHHGGSGHPPSNTPEEEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2217 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagtggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2218 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKVDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2219 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaatgtcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2220 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQCRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2221 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaaatggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2222 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKMDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2223 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaaaggggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2224 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIERGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2225 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggatgcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2226 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWMRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2227 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaaggggcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2228 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKGQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2229 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccctggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2230 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMALVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2231 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgatgccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2232 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPMPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2233 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaggggacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2234 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKGDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2235 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgattacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2236 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVITFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2237 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgccggtttctgaaagcgggcagcgaagaagagattttcgcgcatctgggtctggattatgtggagccgtgggaacgcaacgcg

SEQ ID NO: 2238 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRRFLKAGSEEEIFAHLGLDYVEPWERNA

SEQ ID NO: 2239 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaatttggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2240 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEFGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2241 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggagacggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2242 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAETERGMILDNHALYDLKKRIFLKAGSEEEIFAHLGLDYVEPWERNA

SEQ ID NO: 2243 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaggtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2244 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAERWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2245 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttagtccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2246 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFSPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2247 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaatttgatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2248 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKFDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2249 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaatgttggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2250 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAECWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2251 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcctggcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2252 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRLASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2253 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccaccgtgtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2254 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHRVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2255 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggagtctgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2256 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGSLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2257 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaatgtgatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2258 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKCDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2259 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgatgataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2260 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGDDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2261 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagagggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2262 - protein, 394 aa, synthetic construct
  REGION 1..394: note = Variant of terminal deoxynucleotidyl transferase
MHHHHHHGGSGHPPSNTPEREVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2263 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcaggctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2264 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGRLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2265 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcggggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2266 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGGDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2267 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacccggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2268 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDPAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2269 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtaccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagaggctggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2270 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEEAGMILDNHALYDLKKRIFLKAGSEEEIFAHLGLDYVEPWERNA

SEQ ID NO: 2271 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaagtgtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2272 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEVWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2273 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccggcgattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2274 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPAITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2275 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaaagggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2276 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKRDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2277 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagctggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2278 - protein, 394 aa, synthetic construct
  REGION 1..394: note = Variant of terminal deoxynucleotidyl transferase
MHHHHHHGGSGHPPSNTPELEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2279 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagaggtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2280 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKRYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2281 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagtgttacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2282 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFECYAYALLGWTGSKEFRRDLRRYAEEERGMILDNHALYDLKKRIFLKAGSEEEIFAHLGLDYVEPWERNA

SEQ ID NO: 2283 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagcctggttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2284 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSLVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2285 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttgtgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2286 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFVPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2287 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccctggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2288 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDALDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2289 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatccaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2290 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIQESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2291 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaagttgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2292 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKVDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2293 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcctgaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2294 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCLTDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2295 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcgttgagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2296 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIVESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2297 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagcaacagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2298 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKQQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2299 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaaggcacagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2300 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKAQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2301 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacgcgttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2302 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDAFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2303 - DNA, 1182 bp, synthetic construct; identical to SEQ ID NO: 2293
  misc_feature 1..1182: note = Variant of terminal deoxynucleotidyl transferase
  source 1..1182: mol_type = other DNA

SEQ ID NO: 2304 - protein, 394 aa, synthetic construct; identical to SEQ ID NO: 2294
  REGION 1..394: note = Variant of terminal deoxynucleotidyl transferase

SEQ ID NO: 2305 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcatcttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2306 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSIFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2307 - DNA, 1182 bp, synthetic construct; identical to SEQ ID NO: 2289
  misc_feature 1..1182: note = Variant of terminal deoxynucleotidyl transferase
  source 1..1182: mol_type = other DNA

SEQ ID NO: 2308 - protein, 394 aa, synthetic construct; identical to SEQ ID NO: 2290
  REGION 1..394: note = Variant of terminal deoxynucleotidyl transferase

SEQ ID NO: 2309 - DNA, 1182 bp, synthetic construct; identical to SEQ ID NO: 2287
  misc_feature 1..1182: note = Variant of terminal deoxynucleotidyl transferase
  source 1..1182: mol_type = other DNA

SEQ ID NO: 2310 - protein, 394 aa, synthetic construct; identical to SEQ ID NO: 2288
  REGION 1..394: note = Variant of terminal deoxynucleotidyl transferase

SEQ ID NO: 2311 - DNA, 1182 bp, synthetic construct; identical to SEQ ID NO: 2291
  misc_feature 1..1182: note = Variant of terminal deoxynucleotidyl transferase
  source 1..1182: mol_type = other DNA

SEQ ID NO: 2312 - protein, 394 aa, synthetic construct; identical to SEQ ID NO: 2292
  REGION 1..394: note = Variant of terminal deoxynucleotidyl transferase

SEQ ID NO: 2313 - DNA, 1182 bp, synthetic construct; identical to SEQ ID NO: 2295
  misc_feature 1..1182: note = Variant of terminal deoxynucleotidyl transferase
  source 1..1182: mol_type = other DNA

SEQ ID NO: 2314 - protein, 394 aa, synthetic construct; identical to SEQ ID NO: 2296
  REGION 1..394: note = Variant of terminal deoxynucleotidyl transferase

SEQ ID NO: 2315 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgaccaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2316 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLTKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2317 - DNA, 1182 bp, synthetic construct; identical to SEQ ID NO: 2301
  misc_feature 1..1182: note = Variant of terminal deoxynucleotidyl transferase
  source 1..1182: mol_type = other DNA

SEQ ID NO: 2318 - protein, 394 aa, synthetic construct; identical to SEQ ID NO: 2302
  REGION 1..394: note = Variant of terminal deoxynucleotidyl transferase

SEQ ID NO: 2319 - DNA, 1182 bp, synthetic construct; identical to SEQ ID NO: 2291
  misc_feature 1..1182: note = Variant of terminal deoxynucleotidyl transferase
  source 1..1182: mol_type = other DNA

SEQ ID NO: 2320 - protein, 394 aa, synthetic construct; identical to SEQ ID NO: 2292
  REGION 1..394: note = Variant of terminal deoxynucleotidyl transferase

SEQ ID NO: 2321 - DNA, 1182 bp, synthetic construct; identical to SEQ ID NO: 2305
  misc_feature 1..1182: note = Variant of terminal deoxynucleotidyl transferase
  source 1..1182: mol_type = other DNA

SEQ ID NO: 2322 - protein, 394 aa, synthetic construct; identical to SEQ ID NO: 2306
  REGION 1..394: note = Variant of terminal deoxynucleotidyl transferase

SEQ ID NO: 2323 - DNA, 1182 bp, synthetic construct; identical to SEQ ID NO: 2293
  misc_feature 1..1182: note = Variant of terminal deoxynucleotidyl transferase
  source 1..1182: mol_type = other DNA

SEQ ID NO: 2324 - protein, 394 aa, synthetic construct; identical to SEQ ID NO: 2294
  REGION 1..394: note = Variant of terminal deoxynucleotidyl transferase

SEQ ID NO: 2325 - DNA, 1182 bp, synthetic construct; identical to SEQ ID NO: 2289
  misc_feature 1..1182: note = Variant of terminal deoxynucleotidyl transferase
  source 1..1182: mol_type = other DNA

SEQ ID NO: 2326 - protein, 394 aa, synthetic construct; identical to SEQ ID NO: 2290
  REGION 1..394: note = Variant of terminal deoxynucleotidyl transferase

SEQ ID NO: 2327 - DNA, 1182 bp, synthetic construct; identical to SEQ ID NO: 2291
  misc_feature 1..1182: note = Variant of terminal deoxynucleotidyl transferase
  source 1..1182: mol_type = other DNA

SEQ ID NO: 2328 - protein, 394 aa, synthetic construct; identical to SEQ ID NO: 2292
  REGION 1..394: note = Variant of terminal deoxynucleotidyl transferase

SEQ ID NO: 2329 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcttcaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggtatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2330 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCFTDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2331 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgcatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2332 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITHPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2333 - DNA, 1182 bp, synthetic construct; identical to SEQ ID NO: 2301
  misc_feature 1..1182: note = Variant of terminal deoxynucleotidyl transferase
  source 1..1182: mol_type = other DNA

SEQ ID NO: 2334 - protein, 394 aa, synthetic construct; identical to SEQ ID NO: 2302
  REGION 1..394: note = Variant of terminal deoxynucleotidyl transferase

SEQ ID NO: 2335 - DNA, 1182 bp, synthetic construct; identical to SEQ ID NO: 2295
  misc_feature 1..1182: note = Variant of terminal deoxynucleotidyl transferase
  source 1..1182: mol_type = other DNA

SEQ ID NO: 2336 - protein, 394 aa, synthetic construct; identical to SEQ ID NO: 2296
  REGION 1..394: note = Variant of terminal deoxynucleotidyl transferase

SEQ ID NO: 2337 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagccgtatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2338 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSRMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2339 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcctgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2340 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGLKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2341 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgaacaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2342 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLNKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2343 - DNA, 1182 bp, synthetic construct; identical to SEQ ID NO: 2293
  misc_feature 1..1182: note = Variant of terminal deoxynucleotidyl transferase
  source 1..1182: mol_type = other DNA

SEQ ID NO: 2344 - protein, 394 aa, synthetic construct; identical to SEQ ID NO: 2294
  REGION 1..394: note = Variant of terminal deoxynucleotidyl transferase

SEQ ID NO: 2345 - DNA, 1182 bp, synthetic construct; identical to SEQ ID NO: 2287
  misc_feature 1..1182: note = Variant of terminal deoxynucleotidyl transferase
  source 1..1182: mol_type = other DNA

SEQ ID NO: 2346 - protein, 394 aa, synthetic construct; identical to SEQ ID NO: 2288
  REGION 1..394: note = Variant of terminal deoxynucleotidyl transferase

SEQ ID NO: 2347 - DNA, 1182 bp, synthetic construct; identical to SEQ ID NO: 2305
  misc_feature 1..1182: note = Variant of terminal deoxynucleotidyl transferase
  source 1..1182: mol_type = other DNA

SEQ ID NO: 2348 - protein, 394 aa, synthetic construct; identical to SEQ ID NO: 2306
  REGION 1..394: note = Variant of terminal deoxynucleotidyl transferase

SEQ ID NO: 2349 - DNA, 1182 bp, synthetic construct; identical to SEQ ID NO: 2297
  misc_feature 1..1182: note = Variant of terminal deoxynucleotidyl transferase
  source 1..1182: mol_type = other DNA

SEQ ID NO: 2350 - protein, 394 aa, synthetic construct; identical to SEQ ID NO: 2298
  REGION 1..394: note = Variant of terminal deoxynucleotidyl transferase

SEQ ID NO: 2351 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggaccgcttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2352 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDRFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2353 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2354 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2355 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2356 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2357 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2358 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLKRYAEEERGMILDNHALYDLKKRIFLKAGSEEEIFAHLGLDYVEPWERNA

SEQ ID NO: 2359 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgaacggcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2360 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPNGKEDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2361 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2362 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPVGHDVDFLITNPGRKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2363 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2364 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2365 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2366 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMGEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2367 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2368 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLKRYAEEERGMILDNHALYDLKKRIFLKAGSEEEIFAHLGLDYVEPWERNA

SEQ ID NO: 2369 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2370 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2371 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2372 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASGVSKEEADAVTLIVKNTVRTFLPDALVTITGGFRRGKPVGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2373 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacactgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2374 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2375 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2376 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2377 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2378 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2379 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2380 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2381 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2382 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGGKEDDELLHKVVDLLKTQGLLLYEDIKESTFVEGQLPSRKIDAMDNFQKCFAILKLYQPGVDNSAVGTSKKSDMGEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2383 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccgcaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2384 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITLPGRKEDDELLHKVVDLLKTQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2385 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2386 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPVGHDVDFLITNPGPKEDDELLHKVVDLLKTQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2387 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2388 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITNPGGKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2389 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2390 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2391 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2392 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2393 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2394 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKTQGLLLYEDIKESTFVEGQLPSHKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2395 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2396 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2397 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2398 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2399 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2400 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2401 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2402 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2403 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2404 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2405 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2406 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2407 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2408 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2409 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2410 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2411 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2412 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITNPGPKEDDELLHKVVDLLKTQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2413 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2414 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2415 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2416 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2417 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2418 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2419 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2420 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITLPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2421 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2422 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGRKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2423 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2424 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2425 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2426 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPVGHDVDFLITNPGPKEDDELLHKVVDLLKTQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2427 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2428 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2429 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2430 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2431 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2432 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2433 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2434 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2435 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcggggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2436 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFGVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2437 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2438 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2439 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2440 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASGVSKEEADAVTLIVKNTVRTFLPDALVTITGGFRRGKPVGHDVDFLITLPGPKEDDELLHKVVDLLKTQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2441 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2442 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2443 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2444 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2445 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2446 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2447 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2448 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2449 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2450 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMGEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2451 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2452 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLKRYAEEERGMILDNHALYDLKKRIFLKAGSEEEIFAHLGLDYVEPWERNA

SEQ ID NO: 2453 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2454 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2455 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2456 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2457 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2458 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2459 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2460 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPVGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2461 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2462 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2463 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2464 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2465 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2466 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2467 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2468 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2469 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2470 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2471 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2472 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2473 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2474 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2475 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2476 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2477 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2478 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITLPGPKEDDELLHKVVDLLKTQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2479 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2480 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2481 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2482 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2483 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2484 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2485 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2486 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2487 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2488 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2489 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2490 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2491 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2492 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2493 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgaagcgctatgctgaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2494 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2495 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2496 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2497 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2498 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2499 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2500 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPVGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2501 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2502 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2503 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2504 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2505 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2506 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITLPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2507 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2508 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2509 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2510 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMGEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2511 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2512 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITNPGGKEDDELLHKVVDLLKKQGLLLYEDIKESTFVEGQLPSHKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2513 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2514 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2515 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2516 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2517 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2518 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2519 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2520 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2521 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2522 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2523 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2524 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2525 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2526 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2527 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2528 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2529 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2530 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2531 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2532 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2533 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccgcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2534 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPMGHDVDFLITLPGRKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2535 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2536 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2537 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2538 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2539 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2540 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2541 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2542 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITNPGRKEDDELLHKVVDLLKTQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2543 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2544 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2545 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2546 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2547 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2548 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2549 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2550 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITLPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2551 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2552 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITLPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2553 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2554 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2555 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2556 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITLPGGKEDDELLHKVVDLLKTQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2557 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2558 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2559 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggccctaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2560 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2561 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2562 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2563 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2564 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2565 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtactcgtgtcagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2566 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSHKIDAMDNFQKCFAILKLYQPGVDNSAVGTSKKSDMGEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2567 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2568 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMGEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2569 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2570 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2571 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2572 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASGVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2573 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2574 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASILKYLPFEVTSMKDIQGLPCITDQVRDVIEEIIEEGESSRVKEVLNDERYKAFKQFSSVFGVGVKTAEKWFRMGLRTVEEARASKSLKLSKMQKAGFLYYEDLASGVSKEEADAVTLIVKNTVRTFLPDALVTITGGFRRGKPMGHDVDFLITLPGGKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2575 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2576 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2577 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2578 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2579 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2580 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2581 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2582 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPVGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2583 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2584 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2585 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2586 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2587 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgacggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2588 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLTDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2589 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2590 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFSSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGGKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2591 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggcggcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2592 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFSSVFGVGVKTAEKWYRMGLRTVEEARASKSLKLSKMQKAGFLYYEDLASRVSKEEADAVTLIVKNTVRTFLPDALVTITGGFRRGKPMGHDVDFLITLPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2593 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2594 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFSSVFGVGVKTAEKWYRMGLRTVEEARASKSLKLSKMQKAGFLYYEDLASGVSKEEADAVTLIVKNTVRTFLPDALVTITGGFRRGKPVGHDVDFLITNPGPKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2595 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcggggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2596 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFGVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2597 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2598 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFSSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2599 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2600 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITLPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2601 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2602 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASGVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLKRYAEEERGMILDNHALYDLKKRIFLKAGSEEEIFAHLGLDYVEPWERNA

SEQ ID NO: 2603 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2604 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASGVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2605 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2606 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2607 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2608 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPVGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2609 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2610 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPVGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2611 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2612 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGGKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2613 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2614 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2615 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2616 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2617 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2618 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2619 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2620 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2621 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2622 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPVGHDVDFLITLPGPKEDDELLHKVVDLLKTQGLLLYEDIKESTFVEGQLPSHKIDAMDNFQKCFAILKLYQPGVDNSAVGTSKKSDMGEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2623 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2624 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2625 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2626 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2627 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2628 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2629 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2630 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2631 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2632 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASGVSKEEADAVTLIVKNTVRTFLPDALVTITGGFRRGKPMGHDVDFLITLPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2633 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgtaaaaacgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2634 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITLPGPKEDDELLHKVVDLLKKQGLLLYEDIKESTFVEGQLPSRKNDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2635 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2636 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2637 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggccctaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2638 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKLTDALEIMAENYKFKENLIACLEAKRAASIFKYLPFEVTSMKDIQGLPCITDQVRDVIEEIIEEGESSRVKEVLNDERYKAFKQFSSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2639 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2640 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2641 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2642 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2643 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgcgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2644 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSAFGVGVKTAEKWFRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKTQGLLLYEDIKESTFVEGQLPSRKIDAMDNFQKCFAILKLYQPGVDNSAVGTSKKSDMAEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2645 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagccaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2646 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGRKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2647 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgatgaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2648 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVDEAKASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2649 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggcggcaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2650 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPVGHDVDFLITLPGGKEDDELLHKVVDLLKTQGLLLYEDIKESTFVEGQLPSHKIDAMDNFQKCFAILKLYQPGVDNSAVGTSKKSDMGEVKDWKAVRVDLVITPFEQYAYALLGWTGSKEFRRDLKRYAEEERGMILDNHALYDLKKRIFLKAGSEEEIFAHLGLDYVEPWERNA

SEQ ID NO: 2651 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggcggcaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2652 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPMGHDVDFLITNPGGKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2653 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtactcgtgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccctaaagaggatgacgagctgctccacaaagtggttgatctgctcaagaagcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatgggtgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2654 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASMVSKEEADAVTLIVKNTVRTFLPDALVTITGGFRRGKPVGHDVDFLITLPGPKEDDELLHKVVDLLKKQGLLLYEDIKESTFVEGQLPSRKIDAMDNFQKCFAILKLYQPGVDNSAVGTSKKSDMGEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2655 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacgttgactttctgatcacgctgccgggccgcaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2656 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEARASKSLKLSKMQKAGFLYYEDLASRVSKEEADAVTLIVKNTVRTFLPDALVTITGGFRRGKPVGHDVDFLITLPGRKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLKRYAEEERGMILDNHALYDLKKRIFLKAGSEEEIFAHLGLDYVEPWERNA

SEQ ID NO: 2657 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttctccagcgcgttcggtgtgggcgtgaaaaccgcggaaaagtggttccgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatgggtgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2658 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFSSAFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMGEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2659 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaatggccagtaagagtctgaagctgagcaagatgcagaaggcgggctttctgtattacgaggatctggcgagcggcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgctgccgggccctaaagaggatgacgagctgctccacaaagtggttgatctgctcaagacgcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2660 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAMASKSLKLSKMQKAGFLYYEDLASGVSKEEADAVTLIVKNTVRTFLPDALVTITGGFRRGKPMGHDVDFLITLPGPKEDDELLHKVVDLLKTQGLLLYEDIKESTFVEGQLPSHKIDAMDNFQKCFAILKLYQPGVDNSAVGTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2661 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2662 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASMVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2663 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccaagcaataccccggagggggaggtgccgagcgttatcgcccgtccggttagtcagtacgcgtgccagcgcaagaccacgctgaataactacaacaaaaagtttaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgtaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2664 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKNTVRTFLPDALVTITGGFRRGKPMGHDVDFLITNPGPKEDDELLHKVVDLLKTQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2665 - DNA, 1182 bp, synthetic construct; identical to SEQ ID NO: 2353
  misc_feature 1..1182: note = Variant of terminal deoxynucleotidyl transferase
  source 1..1182: mol_type = other DNA

SEQ ID NO: 2666 - protein, 394 aa, synthetic construct; identical to SEQ ID NO: 2354
  REGION 1..394: note = Variant of terminal deoxynucleotidyl transferase

SEQ ID NO: 2667 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcagggagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2668 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIRESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2669 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgtgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2670 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLCRYAEEERGMILDNHALYDLKKRIFLKAGSEEEIFAHLGLDYVEPWERNA

SEQ ID NO: 2671 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcatatgatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2672 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHMIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2673 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgttggtatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2674 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRWYAEEERGMILDNHALYDLKKRIFLKAGSEEEIFAHLGLDYVEPWERNA

SEQ ID NO: 2675 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaagaggacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2676 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKEDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2677 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcgctatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2678 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSAMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2679 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagactctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2680 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKTLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2681 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctaggtaagcgcatctttctgaaagcgggcagcgaagaagagattttcgcgcatctgggtctggattatgtggagccgtgggaacgcaacgcg

SEQ ID NO: 2682 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLGKRIFLKAGSEEEIFAHLGLDYVEPWERNA

SEQ ID NO: 2683 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcagtatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2684 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRQYAEEERGMILDNHALYDLKKRIFLKAGSEEEIFAHLGLDYVEPWERNA

SEQ ID NO: 2685 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaacctagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2686 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKPSTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2687 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttctcgaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2688 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFSKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2689 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcatgggatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2690 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHGIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2691 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagggtatctttctgaaagcgggcagcgaagaagagattttcgcgcatctgggtctggattatgtggagccgtgggaacgcaacgcg

SEQ ID NO: 2692 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKGIFLKAGSEEEIFAHLGLDYVEPWERNA

SEQ ID NO: 2693 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgatgagcgaagaagagattttcgcgcatctgggtctggattatgtggagccgtgggaacgcaacgcg

SEQ ID NO: 2694 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAMSEEEIFAHLGLDYVEPWERNA

SEQ ID NO: 2695 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagagggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2696 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQRAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2697 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcagtcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2698 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFSQYAYALLGWTGSKQFRRDLRRYAEEERGMILDNHALYDLKKRIFLKAGSEEEIFAHLGLDYVEPWERNA

SEQ ID NO: 2699 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgccggcgggcagcgaagaagagattttcgcgcatctgggtctggattatgtggagccgtgggaacgcaacgcg

SEQ ID NO: 2700 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLPAGSEEEIFAHLGLDYVEPWERNA

SEQ ID NO: 2701 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagccgtatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2702 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSRMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2703 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgctcgtttctgaaagcgggcagcgaagaagagattttcgcgcatctgggtctggattatgtggagccgtgggaacgcaacgcg

SEQ ID NO: 2704 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRSFLKAGSEEEIFAHLGLDYVEPWERNA

SEQ ID NO: 2705 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgagtaagcgcatctttctgaaagcgggcagcgaagaagagattttcgcgcatctgggtctggattatgtggagccgtgggaacgcaacgcg

SEQ ID NO: 2706 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLSKRIFLKAGSEEEIFAHLGLDYVEPWERNA

SEQ ID NO: 2707 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaagagcgcatctttctgaaagcgggcagcgaagaagagattttcgcgcatctgggtctggattatgtggagccgtgggaacgcaacgcg

SEQ ID NO: 2708 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKERIFLKAGSEEEIFAHLGLDYVEPWERNA

SEQ ID NO: 2709 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtgtttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2710 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRVYAEEERGMILDNHALYDLKKRIFLKAGSEEEIFAHLGLDYVEPWERNA

SEQ ID NO: 2711 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccatgggagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2712 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPWEQYAYALLGWTGSKQFRRDLRRYAEEERGMILDNHALYDLKKRIFLKAGSEEEIFAHLGLDYVEPWERNA

SEQ ID NO: 2713 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2714 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQIPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2715 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgtctagcgaagaagagattttcgcgcatctgggtctggattatgtggagccgtgggaacgcaacgcg

SEQ ID NO: 2716 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKASSEEEIFAHLGLDYVEPWERNA

SEQ ID NO: 2717 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2718 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQVPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2719 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtttgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2720 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQFAYALLGWTGSKQFRRDLRRYAEEERGMILDNHALYDLKKRIFLKAGSEEEIFAHLGLDYVEPWERNA

SEQ ID NO: 2721 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2722 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMLLDNHALYDLKKRIFLKAGSEEEIFAHLGLDYVEPWERNA

SEQ ID NO: 2723 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgtgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtgggaaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2724 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVCTFLPDALVTITGGFRRGKPMGHDVDFLITNPGRKEDDELLHKVVDLLKKQGLLLYEDIKESTFVEGQLPSGKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2725 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2726 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRIYAEEERGMILDNHALYDLKKRIFLKAGSEEEIFAHLGLDYVEPWERNA

SEQ ID NO: 2727 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtgcttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2728 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRAYAEEERGMILDNHALYDLKKRIFLKAGSEEEIFAHLGLDYVEPWERNA

SEQ ID NO: 2729 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtactcttatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2730 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYSYALLGWTGSKQFRRDLRRYAEEERGMILDNHALYDLKKRIFLKAGSEEEIFAHLGLDYVEPWERNA

SEQ ID NO: 2731 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtggtgacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2732 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVVTPFEQYAYALLGWTGSKQFRRDLRRYAEEERGMILDNHALYDLKKRIFLKAGSEEEIFAHLGLDYVEPWERNA

SEQ ID NO: 2733 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagctctttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2734 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESSFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2735 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgtggctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2736 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLWLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2737 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaaggttctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2738 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKVLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2739 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacgatttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2740 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDDFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2741 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgagtctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2742 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLSLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2743 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagactctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2744 - protein, 394 aa, synthetic construct; identical to SEQ ID NO: 2680
  REGION 1..394: note = Variant of terminal deoxynucleotidyl transferase

SEQ ID NO: 2745 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttctcgattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2746 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFSILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2747 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagacggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2748 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQTAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2749 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgccatatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2750 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERHMILDNHALYDLKKRIFLKAGSEEEIFAHLGLDYVEPWERNA

SEQ ID NO: 2751 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaacggcgcatctttctgaaagcgggcagcgaagaagagattttcgcgcatctgggtctggattatgtggagccgtgggaacgcaacgcg

SEQ ID NO: 2752 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKRRIFLKAGSEEEIFAHLGLDYVEPWERNA

SEQ ID NO: 2753 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagtgtggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2754 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEECGMILDNHALYDLKKRIFLKAGSEEEIFAHLGLDYVEPWERNA

SEQ ID NO: 2755 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgttcgtatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2756 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRSYAEEERGMILDNHALYDLKKRIFLKAGSEEEIFAHLGLDYVEPWERNA

SEQ ID NO: 2757 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgtggggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2758 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVWGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2759 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctggctctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2760 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLALSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2761 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcgtgtttctgaaagcgggcagcgaagaagagattttcgcgcatctgggtctggattatgtggagccgtgggaacgcaacgcg

SEQ ID NO: 2762 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRVFLKAGSEEEIFAHLGLDYVEPWERNA

SEQ ID NO: 2763 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagtgtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2764 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKCLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2765 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggagggggagctgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2766 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGELPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2767 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagcatctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2768 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKHLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2769 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagaggtgggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2770 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEEVGMILDNHALYDLKKRIFLKAGSEEEIFAHLGLDYVEPWERNA

SEQ ID NO: 2771 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacaagaaaaagcgcatctttctgaaagcgggcagcgaagaagagattttcgcgcatctgggtctggattatgtggagccgtgggaacgcaacgcg

SEQ ID NO: 2772 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDKKKRIFLKAGSEEEIFAHLGLDYVEPWERNA

SEQ ID NO: 2773 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagtttctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2774 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKFLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2775 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaaggagctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2776 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKELKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2777 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatcttttataaagcgggcagcgaagaagagattttcgcgcatctgggtctggattatgtggagccgtgggaacgcaacgcg

SEQ ID NO: 2778 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFYKAGSEEEIFAHLGLDYVEPWERNA

SEQ ID NO: 2779 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcgttgagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2780 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIVESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2781 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttgtgccggatgcgctggtgaccatcaccggcggtttccgccgtggcaaacctatgggccacgacgttgattttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2782 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFVPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2783 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacctgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaaaaaaatctttctgaaagcgggcagcgaagaagagattttcgcgcatctgggtctggattatgtggagccgtgggaacgcaacgcg

SEQ ID NO: 2784 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDLIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKKIFLKAGSEEEIFAHLGLDYVEPWERNA

SEQ ID NO: 2785 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaagaatacggtgcgtacctttctgccggatgcgctggtgaccatcaccggcggtttccgccgtggcaaacctatgggccacgacgttgattttctgatcacgaacccgggtcgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2786 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKMDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2787 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggaggaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgattttctgatcacgaacccgatgcgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggggtggataacagtgcggttgggacgagtaagaaaagtgacatggctgaggttaaggattggaaagcggtccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaagcaaaatctttctgaaagcgggcagcgaagaagagattttcgcgcatctgggtctggattatgtggagccgtgggaacgcaacgcg

SEQ ID NO: 2788 - protein, 394 aa, synthetic construct
  REGION 1..394: note = Variant of terminal deoxynucleotidyl transferase
MHHHHHHGGSGHPPSNTPEEEVPSVIARPVSQYACQRKTTLNNYNKKFTDALEIMAENYKFKENLIACLEAKRAASIFKYLPFEVTSMKDIQGLPCITDDVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPMRKMDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKQFRRDLRRYAEEERGMILDNHALYDLKSKIFLKAGSEEEIFAHLGLDYVEPWERNA

SEQ ID NO: 2789 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacctgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttgtgccggatgcgctggtgaccatcaccggcggtttccgccgtggcaaacctatgggccacgacgttgattttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgccgagctggagcgcgatatgatcctcgacaaccatgccctctacgacctgaaaaaacgtatctttctgaaagcgggcagcgaagaagagattttcgcgcatctgggtctggattatgtggagccgtgggaacgcaacgcg

SEQ ID NO: 2790 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDDVRDLIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFVPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAELERDMILDNHALYDLKKRIFLKAGSEEEIFAHLGLDYVEPWERNA

SEQ ID NO: 2791 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacctgatcgaggagatcatcgaacgtggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgattttctgatcacgaacccgggtcgcaaagaagatgacgagctgctccaccgtgtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2792 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDLIEEIIERGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHRVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2793 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2794 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2795 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgatgcgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaagcaaaatctttctgaaagcgggcagcgaagaagagattttcgcgcatctgggtctggattatgtggagccgtgggaacgcaacgcg

SEQ ID NO: 2796 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPMRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKSKIFLKAGSEEEIFAHLGLDYVEPWERNA

SEQ ID NO: 2797 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaacgtggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2798 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDDVRDVIEEIIERGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2799 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccaccgtgtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2800 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDDVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHRVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2801 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacctgatcgaggagatcatcgaacgtggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaagaacacggtgcgtacctttgtgccggatgcgctggtgaccatcaccggcggtttccgccgtggcaaacctatgggccacgacgttgattttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2802 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDQVRDLIEEIIERGESSRVKEILNDERYKAFKQFTSVFGVGVKTAEKWYRMGLRTVEEAKASKSLKLSKMQKAGFLYYEDLASMVSKEEADAVTLIVKNTVRTFVPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2803 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaagaatacggtgcgtacctttctgccggatgcgctggtgaccatcaccggcggtttccgccgtggcaaacctatgggccacgacgttgattttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2804 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2805 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacctgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcaccggcggtttccgccgtggcaaacctatgggccacgacgttgattttctgatcacgaacccgggccgcaaagaggatgacgagctgctccaccgtgtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2806 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDLIEEIIEEGESSRVKEVLNDERYKAFKQFTSVFGVGVKTAEKWYRMGLRTVEEAKASKSLKLSKMQKAGFLYYEDLASMVSKEEADAVTLIVKETVRTFVPDALVTITGGFRRGKPMGHDVDFLITNPGRKEDDELLHRVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2807 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgattttctgatcacgaacccgggtcgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggtccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2808 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSKQFRRDLRRYAEEERGMILDNHALYDLKKRIFLKAGSEEEIFAHLGLDYVEPWERNA

SEQ ID NO: 2809 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccaccgtgtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2810 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDVIEEIIERGESSRVKEVLNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHRVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2811 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaacgtggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2812 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDDVRDVIEEIIERGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2813 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2814 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2815 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacctgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaatacggtgcgtacctttctgccggatgcgctggtgaccatcaccggcggtttccgccgtggcaaacctatgggccacgacgttgactttctgatcacgaacccgatgcgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgccgaggaggagcgcgatatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2816 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDQVRDLIEEIIEEGESSRVKEILNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPMRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERDMILDNHALYDLKKRIFLKAGSEEEIFAHLGLDYVEPWERNA

SEQ ID NO: 2817 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaagttcgtgacgtgatcgaggagatcatcgaagagggcgagagcagccgtgttaaagaagtcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2818 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2819 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagcgtgaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaatacggtgcgtacctttctgccggatgcgctggtgaccatcaccggcggtttccgccgtggcaaacctatgggccacgacgttgattttctgatcacgaacccgggtcgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggggtggataacagtgcggttgggacgagtaagaaaagtgacatggctgaggttaaggattggaaagcggtccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaaaaaaatctttctgaaagcgggcagcgaagaagagattttcgcgcatctgggtctggattatgtggagccgtgggaacgcaacgcg

SEQ ID NO: 2820 - protein, 394 aa, synthetic construct
  REGION 1..394: note = Variant of terminal deoxynucleotidyl transferase
MHHHHHHGGSGHPPSNTPEREVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKMDDELLHKVVDLLKKQGLLLYEDIKESTFVEGQLPSHKIDAMDNFQKCFAILKLYQPGVDNSAVGTSKKSDMAEVKDWKAVRVDLVITPFEQYAYALLGWTGSKQFRRDLRRYAEEERGMILDNHALYDLKKKIFLKAGSEEEIFAHLGLDYVEPWERNA

SEQ ID NO: 2821 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgatgttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggctttctgtattacgaggatctggcgagcatggttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgggcgtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2822 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASIFKYLPFEVTSMKDIQGLPCITDDVRDVIEEIIEEGESSRVKEVLNDERYKAFKQFTSVFGVGVKTAEKWYRMGLRTVEEAKASKSLKLSKMQKAGFLYYEDLASMVSKEEADAVTLIVKNTVRTFLPDALVTITGGFRRGKPMGHDVDFLITNPGRKEDDELLHKVVDLLKKQGLLLYEDIKESTFVEGQLPSHKIDAMDNFQKCFAILKLYQPGVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2823 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtgtggatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2824 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRVDLRRYAEEERGMILDNHALYDLKKRIFLKAGSEEEIFAHLGLDYVEPWERNA

SEQ ID NO: 2825 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtttggatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2826 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRLDLRRYAEEERGMILDNHALYDLKKRIFLKAGSEEEIFAHLGLDYVEPWERNA

SEQ ID NO: 2827 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaagagcgcatctttctgaaagcgggcagcgaagaagagattttcgcgcatctgggtctggattatgtggagccgtgggaacgcaacgcg

SEQ ID NO: 2828 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKERIFLKAGSEEEIFAHLGLDYVEPWERNA

SEQ ID NO: 2829 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcggcgagcgaagaagagattttcgcgcatctgggtctggattatgtggagccgtgggaacgcaacgcg

SEQ ID NO: 2830 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAASEEEIFAHLGLDYVEPWERNA

SEQ ID NO: 2831 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcggtttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2832 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRRFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2833 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2834 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMLLDNHALYDLKKRIFLKAGSEEEIFAHLGLDYVEPWERNA

SEQ ID NO: 2835 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgctccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2836 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFAPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2837 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgacgagcgaagaagagattttcgcgcatctgggtctggattatgtggagccgtgggaacgcaacgcg

SEQ ID NO: 2838 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKATSEEEIFAHLGLDYVEPWERNA

SEQ ID NO: 2839 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgggctctacgacctgaaaaagcgcatctttctgaaagcgggcagcgaagaagagattttcgcgcatctgggtctggattatgtggagccgtgggaacgcaacgcg

SEQ ID NO: 2840 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHGLYDLKKRIFLKAGSEEEIFAHLGLDYVEPWERNA

SEQ ID NO: 2841 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagatattttcgcgcatctgggtctggattatgtggagccgtgggaacgcaacgcg

SEQ ID NO: 2842 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEDIFAHLGLDYVEPWERNA

SEQ ID NO: 2843 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgccatgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2844 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRHEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2845 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaacagcgcatctttctgaaagcgggcagcgaagaagagattttcgcgcatctgggtctggattatgtggagccgtgggaacgcaacgcg

SEQ ID NO: 2846 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKQRIFLKAGSEEEIFAHLGLDYVEPWERNA

SEQ ID NO: 2847 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagaggtgttcgcgcatctgggtctggattatgtggagccgtgggaacgcaacgcg

SEQ ID NO: 2848 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEVFAHLGLDYVEPWERNA

SEQ ID NO: 2849 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaaactgatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2850 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKTDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2851 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatatgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2852 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDMRRYAEEERGMILDNHALYDLKKRIFLKAGSEEEIFAHLGLDYVEPWERNA

SEQ ID NO: 2853 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtatgaacgcaacgcg

SEQ ID NO: 2854 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPYERNA

SEQ ID NO: 2855 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacaggctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2856 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDRLLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2857 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgacctgctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2858 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2859 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgaggagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2860 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDEELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2861 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagaggtgggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2862 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEEVGMILDNHALYDLKKRIFLKAGSEEEIFAHLGLDYVEPWERNA

SEQ ID NO: 2863 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgccgtgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2864 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRREDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2865 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagtcttacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2866 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFESYAYALLGWTGSKQFRRDLRRYAEEERGMILDNHALYDLKKRIFLKAGSEEEIFAHLGLDYVEPWERNA

SEQ ID NO: 2867 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgatgacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2868 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVMTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2869 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccagcggagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2870 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPAEQYAYALLGWTGSKQFRRDLRRYAEEERGMILDNHALYDLKKRIFLKAGSEEEIFAHLGLDYVEPWERNA

SEQ ID NO: 2871 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggattgtgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2872 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDCELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2873 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggctacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2874 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVATFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2875 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatccttctgaaagcgggcagcgaagaagagattttcgcgcatctgggtctggattatgtggagccgtgggaacgcaacgcg

SEQ ID NO: 2876 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRILLKAGSEEEIFAHLGLDYVEPWERNA

SEQ ID NO: 2877 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgagtagcgaagaagagattttcgcgcatctgggtctggattatgtggagccgtgggaacgcaacgcg

SEQ ID NO: 2878 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKASSEEEIFAHLGLDYVEPWERNA

SEQ ID NO: 2879 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctggcggcgggcagcgaagaagagattttcgcgcatctgggtctggattatgtggagccgtgggaacgcaacgcg

SEQ ID NO: 2880 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLAAGSEEEIFAHLGLDYVEPWERNA

SEQ ID NO: 2881 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccaacggagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2882 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPTEQYAYALLGWTGSKQFRRDLRRYAEEERGMILDNHALYDLKKRIFLKAGSEEEIFAHLGLDYVEPWERNA

SEQ ID NO: 2883 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatacggagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2884 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDTELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2885 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtgctgccgtgggaacgcaacgcg

SEQ ID NO: 2886 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVLPWERNA

SEQ ID NO: 2887 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctatctgaaagcgggcagcgaagaagagattttcgcgcatctgggtctggattatgtggagccgtgggaacgcaacgcg

SEQ ID NO: 2888 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIYLKAGSEEEIFAHLGLDYVEPWERNA

SEQ ID NO: 2889 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgactccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagatcttcgcgcatctgggtctggattatgtggagccgtgggaacgcaacgcg

SEQ ID NO: 2890 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITTPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2891 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgacatgctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2892 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDMLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2893 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgtgctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2894 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTVLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2895 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagagcttgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2896 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKELDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2897 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggcgccgtgggaacgcaacgcg

SEQ ID NO: 2898 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVAPWERNA

SEQ ID NO: 2899 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcaatgaagaagagattttcgcgcatctgggtctggattatgtggagccgtgggaacgcaacgcg

SEQ ID NO: 2900 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGNEEEIFAHLGLDYVEPWERNA

SEQ ID NO: 2901 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagttgggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2902 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEELGMILDNHALYDLKKRIFLKAGSEEEIFAHLGLDYVEPWERNA

SEQ ID NO: 2903 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcagtaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2904 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLISNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2905 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgaatctggattatgtggagccgtgggaacgcaacgcg

SEQ ID NO: 2906 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLNLDYVEPWERNA

SEQ ID NO: 2907 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaacggcgcatctttctgaaagcgggcagcgaagaagagattttcgcgcatctgggtctggattatgtggagccgtgggaacgcaacgcg

SEQ ID NO: 2908 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKRRIFLKAGSEEEIFAHLGLDYVEPWERNA

SEQ ID NO: 2909 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccataggctctacgacctgaaaaagcgcatctttctgaaagcgggcagcgaagaagagattttcgcgcatctgggtctggattatgtggagccgtgggaacgcaacgcg

SEQ ID NO: 2910 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHRLYDLKKRIFLKAGSEEEIFAHLGLDYVEPWERNA

SEQ ID NO: 2911 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatagggagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2912 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDRELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2913 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggggacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2914 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVGTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2915 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcatgcatctgggtctggattatgtggagccgtgggaacgcaacgcg

SEQ ID NO: 2916 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFMHLGLDYVEPWERNA

SEQ ID NO: 2917 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggagattgagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2918 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEIERGMILDNHALYDLKKRIFLKAGSEEEIFAHLGLDYVEPWERNA

SEQ ID NO: 2919 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatacgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2920 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDTRRYAEEERGMILDNHALYDLKKRIFLKAGSEEEIFAHLGLDYVEPWERNA

SEQ ID NO: 2921 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatctgtccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2922 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVICPFEQYAYALLGWTGSKQFRRDLRRYAEEERGMILDNHALYDLKKRIFLKAGSEEEIFAHLGLDYVEPWERNA

SEQ ID NO: 2923 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggcagtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2924 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGSKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2925 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatttggagccgtgggaacgcaacgcg

SEQ ID NO: 2926 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYLEPWERNA

SEQ ID NO: 2927 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcggaggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2928 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDAEVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2929 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgtatccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2930 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITYPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2931 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcgatgaagaagagattttcgcgcatctgggtctggattatgtggagccgtgggaacgcaacgcg

SEQ ID NO: 2932 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGDEEEIFAHLGLDYVEPWERNA

SEQ ID NO: 2933 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgtctgcgggcagcgaagaagagattttcgcgcatctgggtctggattatgtggagccgtgggaacgcaacgcg

SEQ ID NO: 2934 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLSAGSEEEIFAHLGLDYVEPWERNA

SEQ ID NO: 2935 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcggcggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2936 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDAAVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2937 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcccgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2938 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVIPPFEQYAYALLGWTGSKQFRRDLRRYAEEERGMILDNHALYDLKKRIFLKAGSEEEIFAHLGLDYVEPWERNA

SEQ ID NO: 2939 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgtgtacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2940 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVCTPFEQYAYALLGWTGSKQFRRDLRRYAEEERGMILDNHALYDLKKRIFLKAGSEEEIFAHLGLDYVEPWERNA

SEQ ID NO: 2941 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcgatatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2942 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERDMILDNHALYDLKKRIFLKAGSEEEIFAHLGLDYVEPWERNA

SEQ ID NO: 2943 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgacgacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2944 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVTTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2945 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgggggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2946 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDAGVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2947 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatggtctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2948 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYGLLGWTGSKQFRRDLRRYAEEERGMILDNHALYDLKKRIFLKAGSEEEIFAHLGLDYVEPWERNA

SEQ ID NO: 2949 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgtggacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2950 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVWTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2951 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcgctatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2952 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERAMILDNHALYDLKKRIFLKAGSEEEIFAHLGLDYVEPWERNA

SEQ ID NO: 2953 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtgcagccgtgggaacgcaacgcg

SEQ ID NO: 2954 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVQPWERNA

SEQ ID NO: 2955 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcgatggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2956 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAMEERGMILDNHALYDLKKRIFLKAGSEEEIFAHLGLDYVEPWERNA

SEQ ID NO: 2957 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccgggggcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2958 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPGALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2959 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacgggggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2960 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNGGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2961 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattttgtggagccgtgggaacgcaacgcg

SEQ ID NO: 2962 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDFVEPWERNA

SEQ ID NO: 2963 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcaatatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2964 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERNMILDNHALYDLKKRIFLKAGSEEEIFAHLGLDYVEPWERNA

SEQ ID NO: 2965 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacggggccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2966 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITGPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2967 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgggctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2968 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDGLVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2969 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagaggggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2970 - protein, 394 aa, synthetic construct
  REGION 1..394: note = Variant of terminal deoxynucleotidyl transferase
MHHHHHHGGSGHPPGNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2971 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagcgtgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2972 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQRAYALLGWTGSKQFRRDLRRYAEEERGMILDNHALYDLKKRIFLKAGSEEEIFAHLGLDYVEPWERNA

SEQ ID NO: 2973 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgctcggaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2974 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRSEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 2975 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcgactgaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2976 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYATEERGMILDNHALYDLKKRIFLKAGSEEEIFAHLGLDYVEPWERNA

SEQ ID NO: 2977 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2978 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 2979 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatttgagcagtacgcctatgcgctgctcggttggacgggcagcaaacaatttcgtcgcgatctgcgtgtatatgcggaggaagagcgcggcatgattctcgacaaccatgccctctacgacctgaaagagcgcatctttctgaaagcgggcagcgaagaagagattttcgcgcatctgggtctggattatgtggagccgtgggaacgcaacgcg

SEQ ID NO: 2980 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQYAYALLGWTGSKQFRRDLRVYAEEERGMILDNHALYDLKERIFLKAGSEEEIFAHLGLDYVEPWERNA

SEQ ID NO: 2981 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagttcgcctatgcgctgctcggttggacgggcagcaaacaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2982 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPWEQFAYALLGWTGSKQFRRDLRIYAEEERGMILDNHALYDLKKRIFLKAGSEEEIFAHLGLDYVEPWERNA

SEQ ID NO: 2983 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtatttatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2984 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRIYAEEERGMILDNHALYDLKKRIFLKAGSEEEIFAHLGLDYVEPWERNA

SEQ ID NO: 2985 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtgtatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2986 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQYAYALLGWTGSKQFRRDLRVYAEEERGMILDNHALYDLKKRIFLKAGSEEEIFAHLGLDYVEPWERNA

SEQ ID NO: 2987 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtatttatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2988 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQYAYALLGWTGSKQFRRDLRIYAEEERGMILDNHALYDLKKRIFLKAGSEEEIFAHLGLDYVEPWERNA

SEQ ID NO: 2989 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtcatgaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2990 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACHEAKRAASIFKYLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFLPDALVTITGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 2991 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtcatgaagccaagcgcgccgcgagtatttttaaaagcctgccgttcgaggtcaccagcatgaaagacatccaaggtctgccgtgcattaccgaccagtgccgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2992 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACHEAKRAASIFKSLPFEVTSMKDIQGLPCITDQCRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFLPDALVTITGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 2993 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtgtatatgcggaggaagagcgcggcatgattctcgacaaccatgccctctacgacctgaaaaagcgcatctttctgaaagcgggtagcgaagaagagattttcgcgcatctgggtctggattatgtggagccgtgggaacgcaacgcg

SEQ ID NO: 2994 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQYAYALLGWTGSKQFRRDLRVYAEEERGMILDNHALYDLKKRIFLKAGSEEEIFAHLGLDYVEPWERNA

SEQ ID NO: 2995 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtatttatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2996 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQYAYALLGWTGSKQFRRDLRIYAEEERGMLLDNHALYDLKKRIFLKAGSEEEIFAHLGLDYVEPWERNA

SEQ ID NO: 2997 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaatatctgccgttcgaggtcaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggagctggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2998 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAELERGMILDNHALYDLKKRIFLKAGSEEEIFAHLGLDYVEPWERNA

SEQ ID NO: 2999 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtgtatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3000 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRVYAEEERGMILDNHALYDLKKRIFLKAGSEEEIFAHLGLDYVEPWERNA

SEQ ID NO: 3001 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtgcatatgcggaggaagagcgcggcatgctgctcgacaaccatgccctctacgacctgaaaaagcgcatctttctgaaagcgggtagcgaagaagagattttcgcgcatctgggtctggattatgtggagccgtgggaacgcaacgcg

SEQ ID NO: 3002 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRAYAEEERGMLLDNHALYDLKKRIFLKAGSEEEIFAHLGLDYVEPWERNA

SEQ ID NO: 3003 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgttatgcggaggaagagcgcggcatgctgctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3004 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRRYAEEERGMLLDNHALYDLKERIFLKAGSEEEIFAHLGLDYVEPWERNA

SEQ ID NO: 3005 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatttgagcagttcgcctatgcgctgctcggttggacgggcagcaaacaatttcgtcgcgatctgcgtgcatatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3006 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQFAYALLGWTGSKQFRRDLRAYAEEERGMILDNHALYDLKKRIFLKAGSEEEIFAHLGLDYVEPWERNA

SEQ ID NO: 3007 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatttgagcagttcgcctatgcgctgctcggttggacgggcagcaaacaatttcgtcgcgatctgcgtatttatgcggaggaagagcgcggcatgattctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3008 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQFAYALLGWTGSKQFRRDLRIYAEEERGMILDNHALYDLKERIFLKAGSEEEIFAHLGLDYVEPWERNA

SEQ ID NO: 3009 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatttgagcagttcgcctatgcgctgctcggttggacgggcagcaaacaatttcgtcgcgatctgcgtgtatatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3010 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSKQFRRDLRVYAEEERGMILDNHALYDLKKRIFLKAGSEEEIFAHLGLDYVEPWERNA

SEQ ID NO: 3011 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtgcatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3012 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQYAYALLGWTGSKQFRRDLRAYAEEERGMILDNHALYDLKKRIFLKAGSEEEIFAHLGLDYVEPWERNA

SEQ ID NO: 3013 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagttcgcctatgcgctgctcggttggacgggcagcaaacaatttcgtcgcgatctgcgtatttatgcggaggaagagcgcggcatgattctcgacaaccatgccctctacgacctgaaagagcgcatctttctgaaagcgagtagcgaagaagagattttcgcgcatctgggtctggattatgtggagccgtgggaacgcaacgcg

SEQ ID NO: 3014 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPWEQFAYALLGWTGSKQFRRDLRIYAEEERGMILDNHALYDLKERIFLKASSEEEIFAHLGLDYVEPWERNA

SEQ ID NO: 3015 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagcagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatgggagcagttcgcctatgcgctgctcggttggacgggcagcaaacaatttcgtcgcgatctgcgtcgctatgcggaggaagagcgcggcatgattctcgacaaccatgccctctacgacctgaaagagcgcatctttctgaaagcgagtagcgaagaagagattttcgcgcatctgggtctggattatgtggagccgtgggaacgcaacgcg

SEQ ID NO: 3016 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIERGESSRVKEILNDERYKAFKQFTSVFGVGVKTAEKWYRMGLRTVEAAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPWEQFAYALLGWTGSKQFRRDLRRYAEEERGMILDNHALYDLKERIFLKASSEEEIFAHLGLDYVEPWERNA

SEQ ID NO: 3017 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagttcgcctatgcgctgctcggttggacgggcagcaaacaatttcgtcgcgatctgcgtgtatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3018 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPWEQFAYALLGWTGSKQFRRDLRVYAEEERGMILDNHALYDLKKRIFLKAGSEEEIFAHLGLDYVEPWERNA

SEQ ID NO: 3019 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttccagtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgctgctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3020 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFQYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPFEQYAYALLGWTGSKQFRRDLRRYAEEERGMLLDNHALYDLKERIFLKAGSEEEIFAHLGLDYVEPWERNA

SEQ ID NO: 3021 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgacgattgccgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtaaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggaccacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggagctggagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3022 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDDCRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTIAGGFRRGKPMGHDVDFLITNPGRKEDDELLHKVVDLLKKQGLLLYEDIKESTFVEGQLPSHKIDAMDHFQKCFAILKLYQPKVDNSAVGTSKKSDMAEVKDWKAIRVDLVITPFEQYAYALLGWTGSGQFRRDLRRYAELERDMILDNHALYDLKKRIFLKAGSEEEIFAHLGLDYVEPWERNA

SEQ ID NO: 3023 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3024 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRIYAEEERGMILDNHALYDLKKRIFLKAGSEEEIFAHLGLDYVEPWERNA

SEQ ID NO: 3025 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtgcatatgcggaggaagagcgcggcatgattctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3026 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRAYAEEERGMILDNHALYDLKERIFLKAGSEEEIFAHLGLDYVEPWERNA

SEQ ID NO: 3027 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagttcgcctatgcgctgctcggttggacgggcagcaaacaatttcgtcgcgatctgcgtgcatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3028 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQFAYALLGWTGSKQFRRDLRAYAEEERGMILDNHALYDLKKRIFLKAGSEEEIFAHLGLDYVEPWERNA

SEQ ID NO: 3029 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggaccacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3030 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDHFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3031 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatttgagcagtacgcctatgcgctgctcggttggacgggcagcaaacaatttcgtcgcgatctgcgtgtatatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3032 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRVYAEEERGMILDNHALYDLKKRIFLKAGSEEEIFAHLGLDYVEPWERNA

SEQ ID NO: 3033 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatgggagcagttcgcctatgcgctgctcggttggacgggcagcaaacaatttcgtcgcgatctgcgtcgctatgcggaggaagagcgcggcatgctgctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3034 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPWEQFAYALLGWTGSKQFRRDLRRYAEEERGMLLDNHALYDLKERIFLKAGSEEEIFAHLGLDYVEPWERNA

SEQ ID NO: 3035 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagtacgcctatgcgctgctcggttggacgggcagcaaacaatttcgtcgcgatctgcgtatttatgcggaggaagagcgcggcatgctgctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3036 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSKQFRRDLRIYAEEERGMLLDNHALYDLKERIFLKAGSEEEIFAHLGLDYVEPWERNA

SEQ ID NO: 3037 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatttgagcagtacgcctatgcgctgctcggttggacgggcagcaaacaatttcgtcgcgatctgcgtcgctatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3038 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQYAYALLGWTGSKQFRRDLRRYAEEERGMLLDNHALYDLKKRIFLKAGSEEEIFAHLGLDYVEPWERNA

SEQ ID NO: 3039 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtgcatatgcggaggaagagcgcggcatgatcctcgacaaccatgccctctacgacccgaaaaagcgcatctttctgaaagcgagtagcgaagaagagattttcgcgcatctgggtctggattatgtggagccgtgggaacgcaacgcg

SEQ ID NO: 3040 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSKQFRRDLRAYAEEERGMILDNHALYDPKKRIFLKASSEEEIFAHLGLDYVEPWERNA

SEQ ID NO: 3041 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3042 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 3043 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagtacgcctatgcgctgctcggttggacgggcagcaaacaatttcgtcgcgatctgcgtcgctatgcggaggaagagcgcggcatgatcctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3044 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPWEQYAYALLGWTGSKQFRRDLRRYAEEERGMILDNHALYDLKERIFLKAGSEEEIFAHLGLDYVEPWERNA

SEQ ID NO: 3045 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatttgagcagtacgcctatgcgctgctcggttggacgggcagcaaacaatttcgtcgcgatctgcgtgtatatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3046 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRVYAEEERGMILDNHALYDLKKRIFLKAGSEEEIFAHLGLDYVEPWERNA

SEQ ID NO: 3047 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtatttatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3048 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRIYAEEERGMLLDNHALYDLKKRIFLKAGSEEEIFAHLGLDYVEPWERNA

SEQ ID NO: 3049 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3050 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 3051 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgcaggcgtgtcatgaagccaagcgcgccgcgagtatttttaaatatctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3052 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLQACHEAKRAASIFKYLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3053 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgttatgcggaggaagagcgcggcatgctgctcgacaaccatgccctctacgacctgaaagagcgcatctttctgaaagcgggtagcgaagaagagattttcgcgcatctgggtctggattatgtggagccgtgggaacgcaacgcg

SEQ ID NO: 3054 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSKQFRRDLRRYAEEERGMLLDNHALYDLKERIFLKAGSEEEIFAHLGLDYVEPWERNA

SEQ ID NO: 3055 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcaaacaatttcgtcgcgatctgcgtcgctatgcggaggaagagcgcggcatgctgctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3056 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRRYAEEERGMLLDNHALYDLKERIFLKAGSEEEIFAHLGLDYVEPWERNA

SEQ ID NO: 3057 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatacctgccgttcgaggttaccagcatgaaagacatccaaggtctgccgtgcattaccgaccaggttcgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaagtcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtcgctatgcggaggaagagcgcggcatgattctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3058 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSKQFRRDLRRYAEEERGMILDNHALYDLKKRIFLKAGSEEEIFAHLGLDYVEPWERNA

SEQ ID NO: 3059 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcaaacaatttcgtcgcgatctgcgtgtatatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3060 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPFEQYAYALLGWTGSKQFRRDLRVYAEEERGMLLDNHALYDLKKRIFLKAGSEEEIFAHLGLDYVEPWERNA

SEQ ID NO: 3061 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagtacgcctatgcgctgctcggttggacgggcagcaaacaatttcgtcgcgatctgcgtcgttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3062 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKYLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAIRVDLVITPWEQYAYALLGWTGSKQFRRDLRRYAEEERGMILDNHALYDLKKRIFLKAGSEEEIFAHLGLDYVEPWERNA

SEQ ID NO: 3063 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgcaggcgtgtctggaagccaagcgcgccgcgagtatttttaaatatctgccgttcgaggttaccagcatgaaagacatccaaggtctgccgtgcattaccgacgattgccgtgacctgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcaccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3064 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLQACLEAKRAASIFKYLPFEVTSMKDIQGLPCITDDCRDLIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFVPDALVTITGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3065 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaaagtctgccgttcgaggttaccagcatgaaagacatccaaggtctgccgtgcattaccgaccaggttcgtgacgtgatcgaggagatcatcgaagaaggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaaatcccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcaaacaatttcgtcgcgatctgcgtcgttatgcggaggaagagcgcggcatgattctcgacaaccatgccctctacgacctgaaagagcgcatctttctgaaagcgggcagcgaagaagagattttcgcgcatctgggtctggattatgtggagccgtgggaacgcaacgcg

SEQ ID NO: 3066 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKSLPFEVTSMKDIQGLPCITDQVRDVIEEIIEEGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQYAYALLGWTGSKQFRRDLRRYAEEERGMILDNHALYDLKERIFLKAGSEEEIFAHLGLDYVEPWERNA

SEQ ID NO: 3067 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcctggccgagaactacaaatttaaagagaacctgatcgcgtgtctggaagccaagcgcgccgcgagtatttttaaatatctgccgttcgaggttaccagcatgaaagacatccaaggtctgccgtgcattaccgaccaggttcgtgacgtgatcgaggagatcatcgaacgcggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttctgccggatgcgctggtgaccatcaccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccatttgagcagtacgcctatgcgctgctcggttggacgggcagcaaacaatttcgtcgcgatctgcgtcgctatgcggaggaagagcgcggcatgctgctcgacaaccatgccctctacgacctgaaaaagcgcatctttctgaaagcgagtagcgaagaagagattttcgcgcatctgggtctggattatgtggagccgtgggaacgcaacgcg

SEQ ID NO: 3068 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEILAENYKFKENLIACLEAKRAASIFKYLPFEVTSMKDIQGLPCITDQVRDVIEEIIERGESSRVKEILNDERYKAFKQFTSVFGVGVKTAEKWYRMGLRTVEEAKASKSLKLSKMQKAGFLYYEDLASMVSKEEADAVTLIVKETVRTFLPDALVTITGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSKQFRRDLRRYAEEERGMLLDNHALYDLKKRIFLKASSEEEIFAHLGLDYVEPWERNA

SEQ ID NO: 3069 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3070 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERGMLLDNHALYDLKKRIFLKAGSEEEIFAHLGLDYVEPWERNA

SEQ ID NO: 3071 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgacgacgtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcgattgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3072 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDDVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAIGTSKKSDMAEVKDWKAIRVDLVITPFEQYAYALLGWTGSGQFRRDLRRYAEEERDMLLDNHALYDLKKRIFLKAGSEEEIFAHLGLDYVEPWERNA

SEQ ID NO: 3073 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3074 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3075 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3076 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSGQFRRDLRIYAEEERGMILDNHALYDLKKRIFLKAGSEEEIFAHLGLDYVEPWERNA

SEQ ID NO: 3077 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggaagagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3078 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGKSKKSDMAEVKDWKAIRVDLVITPFEQYAYALLGWTGSGQFRRDLRRYAEEERDMLLDNHALYDLKKRIFLKAGSEEEIFAHLGLDYVEPWERNA

SEQ ID NO: 3079 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3080 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3081 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3082 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3083 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3084 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3085 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggagctggagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3086 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRIYAELERDMILDNHALYDLKKRIFLKAGSEEEIFAHLGLDYVEPWERNA

SEQ ID NO: 3087 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtgtttatgcggaggaagagcgcgacatgctgctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3088 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRVYAEEERDMLLDNHALYDLKKRIFLKAGSEEEIFAHLGLDYVEPWERNA

SEQ ID NO: 3089 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3090 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3091 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3092 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAVRVDLVITPFEQYAYALLGWTGSGQFRRDLRIYAEEERGMILDNHALYDLKKRIFLKAGSEEEIFAHLGLDYVEPWERNA

SEQ ID NO: 3093 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3094 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMLLDNHALYDLKKRIFLKAGSEEEIFAHLGLDYVEPWERNA

SEQ ID NO: 3095 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtcatgaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3096 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACHEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3097 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagttcgcctatgcgctgctcggttggacgggcagcggccaatttcgtcgcgatctgcgtgtttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3098 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQFAYALLGWTGSGQFRRDLRVYAEEERGMILDNHALYDLKKRIFLKAGSEEEIFAHLGLDYVEPWERNA

SEQ ID NO: 3099 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3100 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERGMILDNHALYDLKKRIFLKAGSEEEIFAHLGLDYVEPWERNA

SEQ ID NO: 3101 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3102 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRVYAEEERDMILDNHALYDLKKRIFLKAGSEEEIFAHLGLDYVEPWERNA

SEQ ID NO: 3103 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3104 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3105 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3106 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3107 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3108 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3109 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3110 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMLLDNHALYDLKKRIFLKAGSEEEIFAHLGLDYVEPWERNA

SEQ ID NO: 3111 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3112 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERDMLLDNHALYDLKKRIFLKAGSEEEIFAHLGLDYVEPWERNA

SEQ ID NO: 3113 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3114 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3115 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3116 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3117 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagttcgcctatgcgctgctcggttggacgggcagcggccaatttcgtcgcgatctgcgtatttatgcggagctggagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3118 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQFAYALLGWTGSGQFRRDLRIYAELERDMLLDNHALYDLKKRIFLKAGSEEEIFAHLGLDYVEPWERNA

SEQ ID NO: 3119 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3120 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3121 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3122 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3123 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtagttatgcggaggaagagcgcggcatgatcctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3124 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRSYAEEERGMILDNHALYDLKKRIFLKAGSEEEIFAHLGLDYVEPWERNA

SEQ ID NO: 3125 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggagctggagcgcgacatgctgctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3126 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRIYAELERDMLLDNHALYDLKKRIFLKAGSEEEIFAHLGLDYVEPWERNA

SEQ ID NO: 3127 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3128 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMLLDNHALYDLKKRIFLKAGSEEEIFAHLGLDYVEPWERNA

SEQ ID NO: 3129 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggagctggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3130 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRVYAELERGMILDNHALYDLKKRIFLKAGSEEEIFAHLGLDYVEPWERNA

SEQ ID NO: 3131 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaaacgcatctttctgaaagcgagcagcgaagaagagattttcgcgcatctgggtctggattatgtggagccgtgggaacgcaacgcg

SEQ ID NO: 3132 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKASSEEEIFAHLGLDYVEPWERNA

SEQ ID NO: 3133 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaagaacgcatctttctgaaagcgggcagcgaagaagagattttcgcgcatctgggtctggattatgtggagccgtgggaacgcaacgcg

SEQ ID NO: 3134 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKERIFLKAGSEEEIFAHLGLDYVEPWERNA

SEQ ID NO: 3135 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3136 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERDMILDNHALYDLKKRIFLKAGSEEEIFAHLGLDYVEPWERNA

SEQ ID NO: 3137 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3138 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3139 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagtacgcctatgcgctgctcggttggacgggcagcggccaatttcgtcgcgatctgcgtcgctatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3140 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSGQFRRDLRRYAEEERGMLLDNHALYDLKKRIFLKAGSEEEIFAHLGLDYVEPWERNA

SEQ ID NO: 3141 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3142 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERGMILDNHALYDLKKRIFLKAGSEEEIFAHLGLDYVEPWERNA

SEQ ID NO: 3143 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggagctggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3144 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRVYAELERGMILDNHALYDLKKRIFLKAGSEEEIFAHLGLDYVEPWERNA

SEQ ID NO: 3145 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagttcgcctatgcgctgctcggttggacgggcagcggccaatttcgtcgcgatctgcgtatttatgcggaggaagagcgcggcatgatcctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3146 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQFAYALLGWTGSGQFRRDLRIYAEEERGMILDNHALYDLKKRIFLKAGSEEEIFAHLGLDYVEPWERNA

SEQ ID NO: 3147 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3148 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3149 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgtcattcgagcagtacgcctatgcgctgctcggttggacgggcagcggccaatttcgtcgcgatctgcgtatttatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3150 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITSFEQYAYALLGWTGSGQFRRDLRIYAEEERDMLLDNHALYDLKKRIFLKAGSEEEIFAHLGLDYVEPWERNA

SEQ ID NO: 3151 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaagaacgcatctttctgaaagcgggcagcgaagaagagattttcgcgcatctgggtctggattatgtggagccgtgggaacgcaacgcg

SEQ ID NO: 3152 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKERIFLKAGSEEEIFAHLGLDYVEPWERNA

SEQ ID NO: 3153 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggagctggagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3154 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRVYAELERGMLLDNHALYDLKKRIFLKAGSEEEIFAHLGLDYVEPWERNA

SEQ ID NO: 3155 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagttcgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3156 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQFAYALLGWTGSGQFRRDLRIYAEEERGMILDNHALYDLKKRIFLKAGSEEEIFAHLGLDYVEPWERNA

SEQ ID NO: 3157 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagttcgcctatgcgctgctcggttggacgggcagcggccaatttcgtcgcgatctgcgtgtttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3158 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQFAYALLGWTGSGQFRRDLRVYAEEERGMILDNHALYDLKKRIFLKAGSEEEIFAHLGLDYVEPWERNA

SEQ ID NO: 3159 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3160 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSGQFRRDLRRYAEEERDMILDNHALYDLKKRIFLKAGSEEEIFAHLGLDYVEPWERNA

SEQ ID NO: 3161 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagtacgcctatgcgctgctcggttggacgggcagcggccaatttcgtcgcgatctgcgtatttatgcggagctggagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3162 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSGQFRRDLRIYAELERGMILDNHALYDLKKRIFLKAGSEEEIFAHLGLDYVEPWERNA

SEQ ID NO: 3163 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3164 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERGMILDNHALYDLKKRIFLKAGSEEEIFAHLGLDYVEPWERNA

SEQ ID NO: 3165 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3166 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3167 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3168 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRIYAEEERGMILDNHALYDLKKRIFLKAGSEEEIFAHLGLDYVEPWERNA

SEQ ID NO: 3169 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagttcgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3170 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQFAYALLGWTGSGQFRRDLRRYAEEERGMILDNHALYDLKKRIFLKAGSEEEIFAHLGLDYVEPWERNA

SEQ ID NO: 3171 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3172 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3173 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3174 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRVYAEEERGMILDNHALYDLKKRIFLKAGSEEEIFAHLGLDYVEPWERNA

SEQ ID NO: 3175 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagttcgcctatgcgctgctcggttggacgggcagcggccaatttcgtcgcgatctgcgtgtttatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3176 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQFAYALLGWTGSGQFRRDLRVYAEEERGMILDNHALYDLKKRIFLKAGSEEEIFAHLGLDYVEPWERNA

SEQ ID NO: 3177 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3178 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3179 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3180 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3181 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3182 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERGMILDNHALYDLKKRIFLKAGSEEEIFAHLGLDYVEPWERNA

SEQ ID NO: 3183 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaagaacgcatctttctgaaagcgagcagcgaagaagagattttcgcgcatctgggtctggattatgtggagccgtgggaacgcaacgcg

SEQ ID NO: 3184 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKERIFLKASSEEEIFAHLGLDYVEPWERNA

SEQ ID NO: 3185 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3186 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERDMILDNHALYDLKKRIFLKAGSEEEIFAHLGLDYVEPWERNA

SEQ ID NO: 3187 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtgtttatgcggaggaagagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3188 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRVYAEEERGMLLDNHALYDLKKRIFLKAGSEEEIFAHLGLDYVEPWERNA

SEQ ID NO: 3189 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3190 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3191 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtcgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3192 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPFEQYAYALLGWTGSGQFRRDLRRYAEEERGMILDNHALYDLKKRIFLKAGSEEEIFAHLGLDYVEPWERNA

SEQ ID NO: 3193 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttgaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3194 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFEENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMILDNHALYDLKKRIFLKAGSEEEIFAHLGLDYVEPWERNA

SEQ ID NO: 3195 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaggtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccggaccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccattcgagcagtacgcctatgcgctgctcggttggacgggcagcggccaatttcgtcgcgatctgcgtatttatgcggagctggagcgcggcatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3196 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPDRKEDDELLHKVVDLLKKQGLLLYEDIKESTFVEGQLPSHKIDAMDNFQKCFAILKLYQPKVDNSAVGTSKKSDMAEVKDWKAIRVDLVITPFEQYAYALLGWTGSGQFRRDLRIYAELERGMLLDNHALYDLKKRIFLKAGSEEEIFAHLGLDYVEPWERNA

SEQ ID NO: 3197 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtcatgaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaagtgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgattcgtgtggatctggtgatcacgccatgggagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3198 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACHEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAIRVDLVITPWEQFAYALLGWTGSGQFRRDLRRYAEEERDMLLDNHALYDLKKRIFLKAGSEEEIFAHLGLDYVEPWERNA

SEQ ID NO: 3199 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgatcgcgtgtctggaagccaagcgcgccgcgagtatttttaaaagcctgccgttcgaggttaccagcatgaaagacatccaaggtctgccgtgcattaccgaccaagtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcgatccgtgtggatctggtgatcacgccatgggagcagtacgcctatgcgctgctcggttggacgggcagcggccaatttcgtcgcgatctgcgtatttatgcggagctggagcgcggcatgatcctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3200 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLIACLEAKRAASIFKSLPFEVTSMKDIQGLPCITDQVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAIRVDLVITPWEQYAYALLGWTGSGQFRRDLRIYAELERGMILDNHALYDLKKRIFLKAGSEEEIFAHLGLDYVEPWERNA

SEQ ID NO: 3201 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgaatagcgaagaagagattttcgcgcatctgggtctggattatgtggagccgtgggaacgcaacgcg

SEQ ID NO: 3202 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKANSEEEIFAHLGLDYVEPWERNA

SEQ ID NO: 3203 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcatgaccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3204 - protein, 394 aa, synthetic construct
  REGION 1..394: note = Variant of terminal deoxynucleotidyl transferase
MHHHHHHGGSGHPPSMTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3205 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcgctatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3206 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRAMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3207 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgccagatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3208 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRQMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3209 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcagtcatctgggtctggattatgtggagccgtgggaacgcaacgcg

SEQ ID NO: 3210 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFSHLGLDYVEPWERNA

SEQ ID NO: 3211 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataggccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3212 - protein, 394 aa, synthetic construct
  REGION 1..394: note = Variant of terminal deoxynucleotidyl transferase
MHHHHHHGGSGHPPSNRPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3213 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccctggccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3214 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTLAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3215 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3216 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3217 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgttacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3218 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3219 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3220 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3221 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcatgatatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3222 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHDIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3223 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgttctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3224 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRSVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3225 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcagggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3226 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3227 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaacatggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3228 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEHGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3229 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3230 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3231 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaggagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3232 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFRSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3233 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtggtgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3234 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRGVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3235 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaatggtccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3236 - protein, 394 aa, synthetic construct
  REGION 1..394: note = Variant of terminal deoxynucleotidyl transferase
MHHHHHHGGSGHPPSNGPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3237 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagattaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3238 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKITDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3239 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccttacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3240 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3241 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatccaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3242 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3243 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataaccggaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3244 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNRNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3245 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3246 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3247 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgccgtaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3248 - protein, 394 aa, synthetic construct
  REGION 1..394: note = Variant of terminal deoxynucleotidyl transferase
MHHHHHHGGSGHPPSNTPEKEVPSVIARPVSQYACQRRTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3249 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaatggctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3250 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKWLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3251 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaaaatggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3252 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIENGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3253 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgatctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3254 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDDLLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3255 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtattaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3256 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRIKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3257 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattttgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacagggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3258 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIEEIIEEGESSRVKEILNDERYRAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3259 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaaagtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3260 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIESGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3261 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaagaatgtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3262 - protein, 394 aa, synthetic construct
  REGION 1..394: note = Variant of terminal deoxynucleotidyl transferase
MHHHHHHGGSGHPPSNTPEKNVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3263 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgacggttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3264 - protein, 394 aa, synthetic construct
  REGION 1..394: note = Variant of terminal deoxynucleotidyl transferase
MHHHHHHGGSGHPPSNTPEKEVPTVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3265 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtttgtttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3266 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASLFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3267 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtagtgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgtattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3268 - protein, 394 aa, synthetic construct
  REGION 1..394: note = Variant of terminal deoxynucleotidyl transferase
MHHHHHHGGSGHPPSNTPEKEVPSVIARSVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3269 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaaatgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3270 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEMGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3271 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagctatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3272 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKAILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3273 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcaggcgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3274 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESRRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3275 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggagcagccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3276 - protein, 394 aa, synthetic construct
  REGION 1..394: note = Variant of terminal deoxynucleotidyl transferase
MHHHHHHGGSGHPPSNTPEKEQPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3277 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgttgtgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3278 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRCVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3279 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagggggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3280 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3281 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggagcctccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3282 - protein, 394 aa, synthetic construct
  REGION 1..394: note = Variant of terminal deoxynucleotidyl transferase
MHHHHHHGGSGHPPSNTPEKEPPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3283 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggaggcggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3284 - protein, 394 aa, synthetic construct
  REGION 1..394: note = Variant of terminal deoxynucleotidyl transferase
MHHHHHHGGSGHPPSNTPEAEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3285 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccttggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3286 - protein, 394 aa, synthetic construct
  REGION 1..394: note = Variant of terminal deoxynucleotidyl transferase
MHHHHHHGGSGHPPSNTLEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3287 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3288 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3289 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgccggtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3290 - protein, 394 aa, synthetic construct
  REGION 1..394: note = Variant of terminal deoxynucleotidyl transferase
MHHHHHHGGSGHPPSNTPEKEVPSVIAGPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3291 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatctatgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3292 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIYEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3293 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgactcgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3294 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPTRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3295 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataacgtgaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3296 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNVNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3297 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggagtgtccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3298 - protein, 394 aa, synthetic construct
  REGION 1..394: note = Variant of terminal deoxynucleotidyl transferase
MHHHHHHGGSGHPPSNTPEKECPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3299 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatctcgcgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3300 - protein, 394 aa, synthetic construct
  REGION 1..394: note = Variant of terminal deoxynucleotidyl transferase
MHHHHHHGGSGHPPSNTPEKEVPSVISRPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3301 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3302 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3303 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgattacgccattcgagcagttcgcctatgcgctgctcggttggacgggcagcggccaatttcgtcgcgatctgcgtcgctatgcggaggaagagcgcgacatgctgctcgacaaccatgccctctacgacctgaaagaacgcatctatctgaaagcgggcagcgaagaagagattttcgcgcatctgggtctggattatctggagccgtgggaacgcaacgcg

SEQ ID NO: 3304 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKERIYLKAGSEEEIFAHLGLDYLEPWERNA

SEQ ID NO: 3305 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggcagtaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgcactctacgacctgaaaaagcgcatctttctgagtgcgggcagcgaagaagagattttcgctcatctgggtctggattatgtggagccgtgggaacgcaacgcg

SEQ ID NO: 3306 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGSKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLSAGSEEEIFAHLGLDYVEPWERNA

SEQ ID NO: 3307 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataagatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgtgcacgccattcgagcagttcgcctatgcgctgctcggttggacgggcagcggccaatttcgtcgcgatactcgtatttatgcggaggaagagcgcgacatgctgctcgacaaccatgccctctacgacctgaaaaaacgcatctatctgaaagcgggcagcgaagaagagattttcgcgcatctgggtctggattatctggagccgtgggaacgcaacgcg

SEQ ID NO: 3308 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVCTPFEQFAYALLGWTGSGQFRRDTRIYAEEERDMLLDNHALYDLKKRIYLKAGSEEEIFAHLGLDYLEPWERNA

SEQ ID NO: 3309 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggcagtaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagggcatctttctgagtgcgggcagcgaagaagagattttcgcgcatctgggtctggattatgtggagccgtgggaacgcaacgcg

SEQ ID NO: 3310 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGSKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKGIFLSAGSEEEIFAHLGLDYVEPWERNA

SEQ ID NO: 3311 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtggtgttgtgccggatgcgctggtgaccatcgccggcggtttccgccgtggcaaacctatgggccacgacgttgactttctgatcacgaacccgggccgtaaaatggatgacgagctgctccacaaagtggttgatctgctcaagaagcaaggtctgctgctgtacgaagacatcaaagagagcacgttcgtggaggggcaactgccaagtcatgggatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagcgcatctttctgaaagcgggcagcgaagaagagattttcgcgcatctgggtctggattatgtggagccgtgggaacgcaacgcg

SEQ ID NO: 3312 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRGVVPDALVTIAGGFRRGKPMGHDVDFLITNPGRKMDDELLHKVVDLLKKQGLLLYEDIKESTFVEGQLPSHGIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKRIFLKAGSEEEIFAHLGLDYVEPWERNA

SEQ ID NO: 3313 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3314 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3315 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgattacgccattcgagcagttcgcctatgcgctgctcggttggacgggcagcggccaatttcgtcgcgatctgcgtcgctatgcggaggaagagcgcgacatgctgctcgacaaccatgccctctacgacctgaaagaacgcatctttctgaaagcgggcagcgaagaagagattttcgcgcatctgggtctggattatgtggagccgtgggaacgcaacgcg

SEQ ID NO: 3316 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKERIFLKAGSEEEIFAHLGLDYVEPWERNA

SEQ ID NO: 3317 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagggcatctttctgagtgcgggcagcgaagaagagattttcgctcatctgggtctggattatgtggagccgtgggaacgcaacgcg

SEQ ID NO: 3318 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKGIFLSAGSEEEIFAHLGLDYVEPWERNA

SEQ ID NO: 3319 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaagttccaagtcataagatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 3320 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3321 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggcagtaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgctcatctgggtctggattatgtggagccgtgggaacgcaacgcg

SEQ ID NO: 3322 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGSKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3323 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagactctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagggcatctttctgagtgcgggcagcgaagaagagattttcgctcatctgggtctggattatgtggagccgtgggaacgcaacgcg

SEQ ID NO: 3324 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKTLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKGIFLSAGSEEEIFAHLGLDYVEPWERNA

SEQ ID NO: 3325 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgtgcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaaacgcatctatctgaaagcgggcagcgaagaagagattttcgcgcatctgggtctggattatgtggagccgtgggaacgcaacgcg

SEQ ID NO: 3326 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVCTPFEQFAYALLGWTGSGQFRRDLRRYAEEERDMLLDNHALYDLKKRIYLKAGSEEEIFAHLGLDYVEPWERNA

SEQ ID NO: 3327 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcggccgtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataagatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagtacgcctatgctctgctcggttggacgggcagcggccaatttcgtcgcgatctgcgtcgctatgcggaggaagagcgcgacatgctgctcgacaaccatcgtctctacgacctgaaaaagcgcatctttctgagtgcgggcagcgaagaagagattttcgctcatctgggtctggattatgtggagccgtgggaacgcaacgcg

SEQ ID NO: 3328 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDAAVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQYAYALLGWTGSGQFRRDLRRYAEEERDMLLDNHRLYDLKKRIFLSAGSEEEIFAHLGLDYVEPWERNA

SEQ ID NO: 3329 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtggtgttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgcactctacgacctgaaaaagcgcatctttctgaaagcgggcagcgaagaagagattttcgcgcatctgggtctggattatgtggagccgtgggaacgcaacgcg

SEQ ID NO: 3330 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRGVVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3331 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaacgtggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgacctgctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataagatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgattacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaaacgcatctttctgaaagcgggcagcgaagaagagattttcgcgcatctgggtctggattatgtggagccgtgggaacgcaacgcg

SEQ ID NO: 3332 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIERGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDLLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3333 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3334 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKTDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3335 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3336 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3337 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3338 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVVPDALVTIAGGFRRGKPMGHDVDLLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3339 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3340 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3341 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3342 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3343 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3344 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3345 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3346 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3347 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcgcacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3348 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRRTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3349 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3350 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3351 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3352 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3353 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3354 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3355 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3356 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKTDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3357 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcacacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3358 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRHTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3359 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3360 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3361 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtcgcgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3362 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRREDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3363 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3364 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3365 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggctaccgttgtgccggatgcggaggtgaccatcgccggcggtttccgccgtggcaaacctatgggccacgacgttgactttctgatcacgaacccgggccgtaaagaagatcgtgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatatgcgtcgctatgcggaggaagagcgcgacatgctgctcgacaaccatcgtctctacgacctgaaaaagggcatctttctgagtgcggcgagcgaagaagagattttcgcgcatctgggtctggattatctggagccgtgggaacgcaacgcg

SEQ ID NO: 3366 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDAEVTIAGGFRRGKPMGHDVDFLITNPGRKEDRELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDMRRYAEEERDMLLDNHRLYDLKKGIFLSAASEEEIFAHLGLDYLEPWERNA

SEQ ID NO: 3367 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3368 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3369 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaaaggcatctttctgagtgcgggcagcgaagaagagattttcgcgcatctgggtctggattatctggagccgtgggaacgcaacgcg

SEQ ID NO: 3370 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3371 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3372 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3373 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtcgcgaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3374 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRREDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3375 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaggtgaccatcgccggcggtttccgccgtggcaaacctatgggccacgacgttgactttctgatcacgaacccgggcagtaaagaagatcgtgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatatgcgtcgctatgcggaggaagagcgcgacatgctgctcgacaaccatcgtctctacgacctgaaaaagggcatctttctgagtgcgggcagcgaagaagagattttcgcgcatctgggtctggattatattgagccgtgggaacgcaacgcg

SEQ ID NO: 3376 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGSKEDRELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDMRRYAEEERDMLLDNHRLYDLKKGIFLSAGSEEEIFAHLGLDYIEPWERNA

SEQ ID NO: 3377 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3378 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3379 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3380 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRRYAEEERDMLLDNHRLYDLKKGIFLSAGSEEEIFAHLGLDYVEPWERNA

SEQ ID NO: 3381 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3382 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3383 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3384 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3385 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacccgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3386 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDTRRYAEEERDMLLDNHRLYDLKKGIFLSAGSEEEIFAHLGLDYLEPWERNA

SEQ ID NO: 3387 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtcgcacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3388 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRRTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3389 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3390 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3391 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3392 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3393 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3394 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3395 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3396 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3397 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3398 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3399 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3400 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3401 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3402 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDFLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3403 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3404 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3405 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3406 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3407 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgtgccggatgcgctggtgaccatcgccggcggtttccgccgtggcaaacctatgggccacgacgttgacctgctgatcacgaacccgggccgtcgcgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3408 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDLLITNPGRREDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRIYAEEERDMLLDNHRLYDLKKGIFLSAGSEEEIFAHLGLDYVEPWERNA

SEQ ID NO: 3409 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3410 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3411 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3412 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRLDLRIYAEEERDMLLDNHRLYDLKKGIFLSAGSEEEIFAHLGLDYVEPWERNA

SEQ ID NO: 3413 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3414 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3415 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3416 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3417 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3418 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3419 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3420 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3421 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3422 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRLDLRIYAEEERDMLLDNHRLYDLKKGIFLSAGSEEEIFAHLGLDYVEPWERNA

SEQ ID NO: 3423 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcgcgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3424 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVAPDALVTIAGGFRRGKPMGHDVDLLITNPGRREDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3425 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgtgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3426 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAVSIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3427 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3428 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDLLITNPGRKEDDELLHKVVDLLKKQGLLLYEDIKESTFVEGQIPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3429 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3430 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRRYAEEERDMLLDNHRLYDLKKGIFLSAGSEEEIFAHLGLDYVEPWERNA

SEQ ID NO: 3431 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgtgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggcagtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaagaaggcatctttctgagtgcgggcagcgaagaagagattttcgcgcatctgggtctggattatgttgagccgtgggaacgcaacgcg

SEQ ID NO: 3432 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAVSIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGSKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKEGIFLSAGSEEEIFAHLGLDYVEPWERNA

SEQ ID NO: 3433 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3434 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3435 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgatgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaaacggatgacgagctcctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3436 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIDEIIEEGESSRVKEILNDERYKAFKQFTSVFGVGVKTSEKWYRMGLRTVEEAKASKSLKLSKMQKAGFLYYEDLASGVSKEEADAVTLIVKETVRTVAPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRIYAEEERDMLLDNHRLYDLKKGIFLSAGSEEEIFAHLGLDYVEPWERNA

SEQ ID NO: 3437 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3438 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVVPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3439 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgtgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggcagtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacccgtcgctatgcggaggaagagcgcgacatgctgctcgacaaccatcgtctctacgacctgaaaaaaggcatctttctgagtgcggggagcgaagaagagattttcgcgcatctgggtctggattatgttgagccgtgggaacgcaacgcg

SEQ ID NO: 3440 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAVSIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGSKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDTRRYAEEERDMLLDNHRLYDLKKGIFLSAGSEEEIFAHLGLDYVEPWERNA

SEQ ID NO: 3441 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtcgcgttgttccggatgcgctggtgaccatcgccggcggtttccgccgtggcaaacctatgggccacgacgttgactttctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3442 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRRVVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3443 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3444 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3445 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3446 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRIYAEEERDMLLDNHRLYDLKKGIFLSAGSEEEIFAHLGLDYVEPWERNA

SEQ ID NO: 3447 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtcacacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3448 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRHTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3449 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3450 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3451 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3452 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3453 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgctccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3454 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVAPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRRYAEEERDMLLDNHRLYDLKKGIFLSAGSEEEIFAHLGLDYVEPWERNA

SEQ ID NO: 3455 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3456 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3457 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaaattccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3458 - protein, 394 aa, synthetic construct; identical to SEQ ID NO: 3392
  REGION 1..394: note = Variant of terminal deoxynucleotidyl transferase

SEQ ID NO: 3459 - DNA, 1182 bp, synthetic construct; identical to SEQ ID NO: 3389
  misc_feature 1..1182: note = Variant of terminal deoxynucleotidyl transferase
  source 1..1182: mol_type = other DNA

SEQ ID NO: 3460 - protein, 394 aa, synthetic construct; identical to SEQ ID NO: 3390
  REGION 1..394: note = Variant of terminal deoxynucleotidyl transferase

SEQ ID NO: 3461 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaaacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3462 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3463 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtcgcgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3464 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRREDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3465 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3466 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3467 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgactttctgatcacgaacccgggccgtaaagaggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3468 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDFLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRVDLRRYAEEERDMLLDNHRLYDLKKGIFLSAGSEEEIFAHLGLDYVEPWERNA

SEQ ID NO: 3469 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtcgcacggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3470 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRRTDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3471 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgttccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3472 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDLLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRIYAEEERDMLLDNHRLYDLKKGIFLSAGSEEEIFAHLGLDYVEPWERNA

SEQ ID NO: 3473 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgctccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3474 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVAPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYVEPWERNA

SEQ ID NO: 3475 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgtgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggcgagcgaagaagaggttttcgcgcatctgggtctggattatgtggagccgtgggaacgcaacgcg

SEQ ID NO: 3476 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAVSIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEVFAHLGLDYVEPWERNA

SEQ ID NO: 3477 - DNA, 1182 bp, synthetic construct; identical to SEQ ID NO: 3363
  misc_feature 1..1182: note = Variant of terminal deoxynucleotidyl transferase
  source 1..1182: mol_type = other DNA

SEQ ID NO: 3478 - protein, 394 aa, synthetic construct; identical to SEQ ID NO: 3364
  REGION 1..394: note = Variant of terminal deoxynucleotidyl transferase

SEQ ID NO: 3479 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtcgcgttgttccggatgcgctggtgaccatcgccggcggtttccgccgtggcaaacctatgggccacgacgttgactttctgatcacgaacccgggccgtaaaacggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtgtggatctgcgtatctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3480 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRRVVPDALVTIAGGFRRGKPMGHDVDFLITNPGRKTDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRVDLRIYAEEERDMLLDNHRLYDLKKGIFLSAGSEEEIFAHLGLDYVEPWERNA

SEQ ID NO: 3481 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtactgttgttccggatgcgctggtgaccatcgccggcggtttccgccgtggcaaacctatgggccacgacgttgacctgctgatcacgaacccgggccgtcacgaggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3482 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRHEDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRLDLRRYAEEERDMLLDNHRLYDLKKGIFLSAGSEEEIFAHLGLDYVEPWERNA

SEQ ID NO: 3483 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatcaaagagagcacgttcgtggaggggcaagttccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtctggatctgcgtcgctatgcggaggaagagcgcgacatgctgctcgacaaccatcgtctctacgacctgaaaaagggcatctttctgagtgcgggcagcgaagaagagattttcgcgcatctgggtctggattatgtggagccgtgggaacgcaacgcg

SEQ ID NO: 3484 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIKESTFVEGQVPSHKIDAMDNFQKCFAILKLYQPKVDNSAVGTSKKSDMAEVKDWKAVRVDLVITPFEQFAYALLGWTGSGQFRLDLRRYAEEERDMLLDNHRLYDLKKGIFLSAGSEEEIFAHLGLDYVEPWERNA

SEQ ID NO: 3485 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcatgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcgcgcatctgggtctggattatctggagccgtgggaacgcaacgcg

SEQ ID NO: 3486 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRHEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFAHLGLDYLEPWERNA

SEQ ID NO: 3487 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3488 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3489 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcgctcatctgggtctggattatctggagccgtgggaacgcaacgcg

SEQ ID NO: 3490 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRKEDDELLHKVVDLLKKQGLLLYEDIRESTFVEGQLPSHKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFAHLGLDYLEPWERNA

SEQ ID NO: 3491 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcggtcatctgggtctggattatctggagccgtgggaacgcaacgcg

SEQ ID NO: 3492 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIRESTFVEGQLPSHKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3493 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcgtgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3494 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRREDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3495 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcgcgcatctgggtctggattatctggagccgtgggaacgcaacgcg

SEQ ID NO: 3496 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFAHLGLDYLEPWERNA

SEQ ID NO: 3497 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3498 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIRESTFVEGQLPSHKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3499 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcagaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3500 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIRESTFVEGQLPSQKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3501 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgctcatctgggtctggattatctggagccgtgggaacgcaacgcg

SEQ ID NO: 3502 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3503 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcagaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgctcatctgggtctggattatctggagccgtgggaacgcaacgcg

SEQ ID NO: 3504 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRKEDDELLHKVVDLLKKQGLLLYEDIRESTFVEGQLPSQKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3505 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcatgaagatgacgagctgctccacaaagtggttgatctgctcaagaagcaaggtctgctgctgtacgaagacatccgtgagagcacgttcgtggaggggcaactgccaagtcagaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3506 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRHEDDELLHKVVDLLKKQGLLLYEDIRESTFVEGQLPSQKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3507 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaaactgatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3508 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKTDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3509 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3510 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3511 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatccaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaaactgatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3512 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASIFKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKTDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3513 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaaactgatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3514 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEIFAHLGLDYLEPWERNA

SEQ ID NO: 3515 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcagaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcggtcatctgggtctggattatctggagccgtgggaacgcaacgcg

SEQ ID NO: 3516 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSQKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3517 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3518 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3519 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3520 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3521 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtcatgaagatgacgagctgctccacaaagtggttgatctgctcaagaagcaaggtctgctgctgtacgaagacatccgtgagagcacgttcgtggaggggcaactgccaagtcataaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3522 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRHEDDELLHKVVDLLKKQGLLLYEDIRESTFVEGQLPSHKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3523 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3524 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3525 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3526 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3527 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcatgaagatgacgagctgctccacaaagtggttgatctgctcaagaagcaaggtctgctgctgtacgaagacatccgtgagagcacgttcgtggaggggcaactgccaagtcataaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3528 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRHEDDELLHKVVDLLKKQGLLLYEDIRESTFVEGQLPSHKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3529 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcgtgaagatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3530 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRREDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3531 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3532 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3533 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3534 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3535 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcgtgaagatgacgagctgctccacaaagtggttgatctgctcaagaagcaaggtctgctgctgtacgaagacatccgtgagagcacgttcgtggaggggcaactgccaagtcagaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3536 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRREDDELLHKVVDLLKKQGLLLYEDIRESTFVEGQLPSQKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3537 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3538 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3539 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3540 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAASEEEIFAHLGLDYLEPWERNA

SEQ ID NO: 3541 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcagaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgctcatctgggtctggattatctggagccgtgggaacgcaacgcg

SEQ ID NO: 3542 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSQKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3543 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3544 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3545 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3546 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3547 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3548 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEIFAHLGLDYLEPWERNA

SEQ ID NO: 3549 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3550 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3551 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3552 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3553 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3554 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3555 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtctttaaaagcctgccgttcgaggttaccagcatgaaagacatccaaggtctgccgtgcattaccgacgacgtacgtgacctgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgctcatctgggtctggattatctggagccgtgggaacgcaacgcg

SEQ ID NO: 3556 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDLIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3557 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcatgatatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3558 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHDIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3559 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3560 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3561 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3562 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3563 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3564 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3565 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3566 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3567 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcctgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatctttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtaaggaagatgacgagctgctccacaaagtggttgatctgctcaagaagcaaggtctgctgctgtacgaagacatccgtgagagcacgttcgtggaggggcaactgccaagtcataaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3568 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3569 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3570 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3571 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgactttctgatcacgaacccgggccgtaaaactgatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3572 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDFLITNPGRKTDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSANSEEEIFAHLGLDYLEPWERNA

SEQ ID NO: 3573 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcatgatatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3574 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHDIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3575 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtccgtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3576 - protein, 394 aa, synthetic construct
  REGION 1..394: note = Variant of terminal deoxynucleotidyl transferase
MHHHHHHGGSGHPPSNTPEKEVPSVIARPVSPYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEIFAHLGLDYLEPWERNA

SEQ ID NO: 3577 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgcaccgttgtgccggatgcgctggtgaccatcgccggcggtttccgccgtggcaaacctatgggccacgacgttgacctgctgatcacgaacccgggccgtaaaactgatgacgaactgctccacaaagtggttgatctgctcaagaagcaaggtctgctgctgtacgaagacatccgtgagagcacgttcgtggaggggcaactgccaagtcatgatatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3578 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKTDDELLHKVVDLLKKQGLLLYEDIRESTFVEGQLPSHDIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEIFAHLGLDYLEPWERNA

SEQ ID NO: 3579 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3580 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFAHLGLDYLEPWERNA

SEQ ID NO: 3581 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaaactgatgacgagctgctccacaaagtggttgatctgctcaagaagcaaggtctgctgctgtacgaagacatccgtgagagcacgttcgtggaggggcaactgccaagtcatgatatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcgcgcatctgggtctggattatctggagccgtgggaacgcaacgcg

SEQ ID NO: 3582 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKTDDELLHKVVDLLKKQGLLLYEDIRESTFVEGQLPSHDIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFAHLGLDYLEPWERNA

SEQ ID NO: 3583 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataaaatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggctagcgaagaagagattttcgcgcatctgggtctggattatctggagccgtgggaacgcaacgcg

SEQ ID NO: 3584 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAASEEEIFAHLGLDYLEPWERNA

SEQ ID NO: 3585 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaacccgggccgtaaagaggatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcgcgcatctgggtctggattatctggagccgtgggaacgcaacgcg

SEQ ID NO: 3586 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFAHLGLDYLEPWERNA

SEQ ID NO: 3587 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagttgctacgcgtgccagcgcaagaccacgctgaataactacaacaaaaagttcaccgacgcgctggagatcatggccgagaactacaaatttaaagagaacctgcaggcgtgtctggaagccaagcgcgccgcgagtattctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtggcaaccgttgtgccggatgcgctggtgaccatcgccggcggtttccgccgtggcaaacctatgggccacgacgttgacctgctgatcacgaacccgggccgtaaagaagatgacgagctgctccacaaagtggttgatctgctcaagaagcaaggtctgctgctgtacgaagacatccgtgagagcacgttcgtggaggggcaactgccaagtcataagatcgacgccctggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgaatagcgaagaagagattttcgcgcatctgggtctggattatctggagccgtgggaacgcaacgcg

SEQ ID NO: 3588 - protein, 394 aa, synthetic construct
  REGION 1..394: note = Variant of terminal deoxynucleotidyl transferase
MHHHHHHGGSGHPPSNTPEKEVPSVIARPVSCYACQRKTTLNNYNKKFTDALEIMAENYKFKENLQACLEAKRAASILKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASMVSKEEADAVTLIVKETVATVVPDALVTIAGGFRRGKPMGHDVDLLITNPGRKEDDELLHKVVDLLKKQGLLLYEDIRESTFVEGQLPSHKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSANSEEEIFAHLGLDYLEPWERNA

SEQ ID NO: 3589 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggccgtaaagaagatgacgagctgctccacaaagtggttgatctgctcaagaagcaaggtctgctgctgtacgaagacatccgtgagagcacgttcgtggaggggcaactgccaagtcagaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggcagcgaagaagagattttcggtcatctgggtctggattatctggagccgtgggaacgcaacgcg

SEQ ID NO: 3590 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTVVPDAEVTIAGGFRRGKPMGHDVDFLITNPGRKEDDELLHKVVDLLKKQGLLLYEDIRESTFVEGQLPSQKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3591 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttagtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 3592 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFSRDLRRYAEEERGMILDNHALYDRKKRIFLKAGSEEEIFAHLGLDYVEPWERNA

SEQ ID NO: 3593 - DNA, 1563 bp, synthetic construct
  misc_feature 1..1563: note = Orthologs of terminal deoxynucleotidyl transferase
  source 1..1563: mol_type = other DNA
atgcaccatcatcatcatcatggcggtagcggcatggatcccttacaagctgtacacctaggacctcgcaagaaacgtccgcgtcaaaccggtgcgtctggcgcctccactccgcatgatatccgtttccgcgacctggttctgttcatcctggaaaaaaagatgggcaccacccgtcgggcgttcctgatggagctggcgcgtcgaaagggttttcgcgtggagaacgagttgtcggatagcgtgactcacatcgtggccgagaacaacagtggctcagacgtgttggagtggctgcagcttcagaatatcaaagcgtcctccgagttcgagctgttggacatcagctggctgatcgagtgtatgggtgctggcaagccggttgaaatggcaggccgtcatcagctggtcgtgcgtcgcaacccgagcctgagcccggtgccgggtagccaaaccgttccaccgccgctgatgcagaagattagccagtatgcctgtcagcgtcgtaccactctgaataaccataaccagttgttcaccgatgcatttgatatcctggcggagaactatgaattccgcgaaaatgaagtctcttgtctgccgttcatgcgtgctgctagcgttctgaaaagccttagctttccgattgtttctatgaaggatatcgagggtattccgtgcctgggcgataaagtaaaatgcgtaattgaaggcatcatcgaggacggtgagtcgtcggaggttaaagctgtcctgaatgatgaacgttacaagtccttcaaattatttacctcagtttttggggtgggtttgaagaccgcagaaaaatggtttaggatgggtttccgtacgctgtccaaaatcaaaagcgacaagagcctgcgcttcacgcacatgcagaaggctggctttctgtactacgaggacttggtgtcttgcgttaacagagcagaagcggaggcggtgtctatgttagtgaaggaggccgttgtagcgtttttgccagacgcgctggtcaccatgacgggcggtttccgccgcggtaagatgacgggccatgacgttgacttcctgatcacctccccggaagcgacggaagaggaagaacagcaattgctccacaaagttaccaatttttggcgtcaacaaggcctgctgctctactgcgatatcattgagtcgaccttcgaaaagtttaagctgccgagccgtaaggtggatgctctggatcattttcaaaagtgctttctgattttaaagttgcaccgcggtctcgtgcgtagcgaagaaagcggtcagcaagaaggtaaggactggaaagcgattcgtgttgacttggtcatgtgcccgtatgagcgtcgtgcgttcgccctgttgggttggaccggctctagacaatttgagcgtgatctgcgtcgctacgcaacccacgagcgcaaaatgatgctggacaaccacgcgctatacgataaaaccaaacgcgttttcctggaagccgagagcgaagaggaaatttttgcgcacctgggtctcgactatattgagccgtgggagcgtaacgca

SEQ ID NO: 3594 - protein, 521 aa, synthetic construct
  REGION 1..521: note = Orthologs of terminal deoxynucleotidyl transferase
MHHHHHHGGSGMDPLQAVHLGPRKKRPRQTGASGASTPHDIRFRDLVLFILEKKMGTTRRAFLMELARRKGFRVENELSDSVTHIVAENNSGSDVLEWLQLQNIKASSEFELLDISWLIECMGAGKPVEMAGRHQLVVRRNPSLSPVPGSQTVPPPLMQKISQYACQRRTTLNNHNQLFTDAFDILAENYEFRENEVSCLPFMRAASVLKSLSFPIVSMKDIEGIPCLGDKVKCVIEGIIEDGESSEVKAVLNDERYKSFKLFTSVFGVGLKTAEKWFRMGFRTLSKIKSDKSLRFTHMQKAGFLYYEDLVSCVNRAEAEAVSMLVKEAVVAFLPDALVTMTGGFRRGKMTGHDVDFLITSPEATEEEEQQLLHKVTNFWRQQGLLLYCDIIESTFEKFKLPSRKVDALDHFQKCFLILKLHRGLVRSEESGQQEGKDWKAIRVDLVMCPYERRAFALLGWTGSRQFERDLRRYATHERKMMLDNHALYDKTKRVFLEAESEEEIFAHLGLDYIEPWERNA

SEQ ID NO: 3595 - DNA, 1551 bp, synthetic construct
  misc_feature 1..1551: note = Orthologs of terminal deoxynucleotidyl transferase
  source 1..1551: mol_type = other DNA
atgcaccatcatcatcatcatggcggtagcggcatggaaagaataaggcccccaacagttgtatcccagcgcaagcgtcagaaaggcatgtattcgccgaaactgagctgtggttatgagatcaaattcaacaaattagtgatcttcattatgcaacgcaagatgggcatgacccgtcgcacctttttgatggaacttgccagaagcaagggcttccgcgtggagtctgaactctctgatagcgtgacccacatcgtggcagaaaacaacagctacccggaagtgctggactggctgaagggccaagcggtgggcgatagctctcgttttgagattctggacatcagctggttgaccgcctgcatggaaatgggtcgcccagtagacctggaaaaaaaatatcatctggtggagcaggcaggtcagtacccgaccctgaagaccccggaatccgaggtctcctcgttcactgcgtccaaagtttcgcaatacagctgtcagcgtaaaacgaccttaaataactgcaacaaaaagttcacggatgcgtttgagatcatggcggagaactatgagttcaaagagaacgaaatcttctgcctggaattcctgcgtgcggcaagtgtgctgaagagcctgccgtttccggtgacgcgtatgaaagacatccagggtttaccgtgtatgggcgatcgtgttcgtgatgttattgaggaaatcatcgaagaaggtgaaagcagcagagcgaaagacgtgctgaatgatgaacgttataaaagctttaaagagttcacttcagttttcggcgttggcgtgaagacgagcgagaaatggtttcgtatgggtctgcgcaccgtagaagaggttaaggctgataaaaccttgaagcttagcaagatgcagcgtgcgggctttttgtactacgaggacctcgttagctgcgtttccaaggcggaggcagacgcggtttcttctatcgtgaagaacaccgtttgtacctttctgccggatgctctggtcacaattaccggtggtttccgccgtggtaaaaaaattggtcatgatattgattttctgattaccagcccgggtcaacgcgaagacgacgagttgctgcacaaaggcctgttgctgtactgcgatatcatcgaatccaccttcgtgaaagaacaaattccgagccgtcacgttgacgctatggatcactttcaaaaatgctttgcgattctgaagctgtaccagccgcgtgtcgacaactcctcgtacaatatgagcaagaagtgcgacatggccgaggttaaggactggaaagccatccgcgtggatctggttatcacgccgttcgagcaatacgcgtatgccttgctgggttggaccggtagccgccagtttggtcgtgatttgagacgttatgctacccacgagcgtaagatgatgctggacaatcatgcgctgtacgataagcgcaagcgtgtgtttttgaaggcaggcagcgaagaagagattttcgcgcatctgggtttggactatgttgagccttgggaacgtaatgct

SEQ ID NO: 3596 - protein, 517 aa, synthetic construct
  REGION 1..517: note = Orthologs of terminal deoxynucleotidyl transferase
MHHHHHHGGSGMERIRPPTVVSQRKRQKGMYSPKLSCGYEIKFNKLVIFIMQRKMGMTRRTFLMELARSKGFRVESELSDSVTHIVAENNSYPEVLDWLKGQAVGDSSRFEILDISWLTACMEMGRPVDLEKKYHLVEQAGQYPTLKTPESEVSSFTASKVSQYSCQRKTTLNNCNKKFTDAFEIMAENYEFKENEIFCLEFLRAASVLKSLPFPVTRMKDIQGLPCMGDRVRDVIEEIIEEGESSRAKDVLNDERYKSFKEFTSVFGVGVKTSEKWFRMGLRTVEEVKADKTLKLSKMQRAGFLYYEDLVSCVSKAEADAVSSIVKNTVCTFLPDALVTITGGFRRGKKIGHDIDFLITSPGQREDDELLHKGLLLYCDIIESTFVKEQIPSRHVDAMDHFQKCFAILKLYQPRVDNSSYNMSKKCDMAEVKDWKAIRVDLVITPFEQYAYALLGWTGSRQFGRDLRRYATHERKMMLDNHALYDKRKRVFLKAGSEEEIFAHLGLDYVEPWERNA

SEQ ID NO: 3597 - DNA, 1560 bp, synthetic construct
  misc_feature 1..1560: note = Orthologs of terminal deoxynucleotidyl transferase
  source 1..1560: mol_type = other DNA
atgcaccatcatcatcatcatggcggtagcggcatggacccaccgcgtgcgtctcacctgagtccacgcaagaaacgccctcgtcagaccggagcacttatggcatcatcaccgcaagacatcaaatttcaggatctggtggtgttcattctcgaaaagaagatgggcacgacgcgtcgtgcgtttttgatggagctggcacgccgcaaagggttccgcgttgaaaacgaactttcggattccgtaacccacattgtcgccgagaataatagcggtagcgacgttctggaatggctgcaggcgcagaaagtgcaagtctcttctcagcccgaattgttggatgtgtcgtggctgatcgaatgcattcgtgcaggcaaaccggttgaaatgacaggcaaacaccaactggtagtacgccgcgactatagtgatagtactaacccaggtccgccgaaaaccccacctatcgctgtgcagaagatttcacaatacgcatgtcagcgtcgtaccaccctcaacaactgcaatcagatctttacggatgccttcgacattcttgcggagaactgtgaatttcgcgagaatgaagatagctgcgtcacttttatgcgtgctgctagcgtgctgaaatccttacccttcacaatcatctccatgaaagataccgaagggattccgtgtttaggcagcaaagttaaaggcattattgaggagatcatcgaagacggagaatcgtcggaagtcaaagcggtgctgaacgatgaacgctatcagagctttaaactgttcacgtccgtgtttggtgttggcctgaagaccagtgagaaatggttccgtatgggttttcgcacgctgtctaaagtccgtagcgacaaatcgctcaaattcactcgcatgcaaaaagcagggtttctgtactacgaagatcttgtttcatgcgtgacacgtgcggaagcggaagcagtatccgtcctggttaaggaagcggtgtgggcgtttttgccggatgcattcgtgaccatgaccggcggttttcgccgcggcaagaagatgggtcacgacgttgatttcctgattacatcgcctggatctacggaggatgaagagcagctgctccagaaagtcatgaatctgtgggaaaagaaaggccttctgctgtattatgacttggtagaaagcacctttgagaaactgcgtttaccgagccgtaaagtggatgctctcgaccacttccagaaatgttttctgatttttaaattaccacgccaacgtgttgattcggatcaaagtagttggcaggaaggtaagacctggaaagcgatccgcgtggaccttgtattatgcccgtatgaacgtcgtgcgttcgcattattggggtggactggctcacgccagtttgagcgcgatttgcgtcgttacgctacgcatgaacgcaagatgattctcgataaccacgcgctttatgacaagaccaaacgcatcttcttgaaagcagaaagcgaagaggagatttttgctcatttaggcctcgattacattgaaccgtgggaacgcaatgca

SEQ ID NO: 3598 - protein, 520 aa, synthetic construct
  REGION 1..520: note = Orthologs of terminal deoxynucleotidyl transferase
MHHHHHHGGSGMDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 3599 - DNA, 1551 bp, synthetic construct
  misc_feature 1..1551: note = Orthologs of terminal deoxynucleotidyl transferase
  source 1..1551: mol_type = other DNA
atgcaccatcatcatcatcatggcggtagcggcatggaacgcattcgtccgccgaccgtggtgtctcagcgcaaacgtcaaaaaggcatgtatagtccaaagctgtcatgcggctacgagatcaaatttaacaagctcgtcatcttcattatgcagcgcaagatgggtatgacgcgtcgtacctttctgatggaattagcgcgctcgaaaggcttccgcgttgaaagcgagctgtctgatagcgtcactcacattgtggccgagaataattcctatcctgaagtattggactggcttaaaggccaggcagttggtgattcgtcgcgctttgaaatcctggacattagttggctgacagcttgtatggaaatggggcgtccggtggatctggagaagaaataccacctcgtagaacaagcggggcagtatcccaccttgaaaacgccggaatccgaagttagctcatttaccgccagcaaagtcagtcagtactcttgccaacgtaagactacgctgaacaactgtaacaagaaattcaccgatgcgtttgaaatcatggctgagaattatgagttcaaagaaaacgaaattttctgcctggaatttttacgtgccgcatccgtgctgaaaagcttgccatttccggttacacgcatgaaagacattcagggccttccttgtatgggtgatcgcgtgcgtgatgtcatcgaggaaatcattgaagaaggcgaatcatcacgtgcgaaagacgtgctgaatgatgagcgctacaaaagcttcaaagaatttacgagtgtttttggagtaggcgtgaagacctcggagaaatggttccgcatgggtttacgtaccgtcgaagaagttaaagcagataagactctgaaactgtccaagatgcaacgtgcggggttcctctattatgaagaccttgtctcttgcgtgagcaaagccgaagcggatgctgtatcgtccatcgtgaagaacacggtttgtacctttttaccggacgcactggtgaccattactggcggttttcgccgcggcaagaagattggtcacgatatcgatttcctgattacaagtccaggacagcgtgaagacgacgagttgctgcacaaagggctgctgctctactgcgatatcatcgagagcacgttcgtcaaagaacagattccgtctcgtcacgttgatgccatggaccattttcagaaatgctttgcgattctgaaattgtatcaaccgcgcgtggataatagcagctacaacatgtcgaagaaatgtgatatggccgaggtcaaagattggaaagcaattcgcgttgacttagtaatcacgccctttgaacagtatgcgtatgctcttctgggttggaccggctcccgtcaatttggccgcgatctgcgtcgttacgcgacccacgagcgcaagatgatgctcgacaatcatgccctgtacgataaacgcaaacgtgtgttcctgaaagcaggttcagaagaagaaattttcgcgcatttaggcctggattatgtagaaccttgggaacgcaacgca

SEQ ID NO: 3600 - protein, 517 aa, synthetic construct; identical to SEQ ID NO: 3596
  REGION 1..517: note = Orthologs of terminal deoxynucleotidyl transferase

SEQ ID NO: 3601 - DNA, 1563 bp, synthetic construct
  misc_feature 1..1563: note = Orthologs of terminal deoxynucleotidyl transferase
  source 1..1563: mol_type = other DNA
atgcaccatcatcatcatcatggcggtagcggcatggacccactgcaggcggtgcacttaggcccacgcaagaaacgtccgcgtcaactggggacccctgttgcctctactccgtatgacattcgctttcgtgatctcgtactgttcatcctggaaaagaaaatgggcacgacgcgccgcgcatttttaatggagttggctcgtcgcaaaggtttccgtgtcgaaaacgaactgagtgattcggtgacccacattgttgccgagaataattccggctcagacgtgcttgaatggctgcagttgcagaacatcaaagcaagcagcgaactggaactcctcgatatttcgtggctgatcgaatgcatgggagcggggaaacccgtcgagatgatgggtcgccaccaactggtagtgaaccgtaattcttctccaagtccggttccgggctcccagaacgtaccggcgcctgccgtgaagaagatttcacagtacgcgtgtcaacgtcgtaccaccctgaacaactataatcagctgtttacagacgctttggatatccttgcagagaatgatgaactgcgcgaaaacgaaggaagttgccttgcgttcatgcgcgcttcgagcgtcctgaaatccttgccctttccgattactagcatgaaagacacggagggtatcccatgtctgggcgacaaagtgaaaagcattattgaaggcatcatcgaagatggtgagagtagtgaagccaaagcggtcctgaatgatgaacgctacaaatcctttaaattgttcacctcagtgtttggcgttgggctgaagacagcagagaaatggttccgtatgggttttcgtaccctctcgaagattcagagcgataaaagccttcgcttcacgcaaatgcagaaagccggctttctgtattatgaagacctggtttcgtgcgttaaccgtccggaagcggaagctgtgtctatgctggtaaaagaggccgtcgtcacctttcttcctgatgcactggtgactatgacgggaggttttcgccgcggcaagatgaccgggcatgatgtggacttcctcattacatcaccggaagcgaccgaagatgaggagcaacagctgttgcacaaagttactgatttctggaaacagcagggtctgctgctgtactgtgacatcttggaaagcacgtttgagaaattcaaacaaccgtcccgtaaagtggatgcgcttgaccattttcagaaatgctttctgattctcaaactggatcatggccgcgttcactctgaaaaaagcggtcaacaagaaggaaagggctggaaagccatccgtgtcgatttggtgatgtgtccatatgatcgccgcgcattcgcgcttcttggttggaccggctcgcgtcagtttgaacgtgacctgcgtcgctacgctacccatgaacgcaagatgatgctggataatcacgccctgtatgaccgtacgaaacgcgtattcctcgaagcggagtcagaagaagaaatttttgcacatctggggctggattacattgaaccgtgggagcgtaacgct

SEQ ID NO: 3602 - protein, 521 aa, synthetic construct
  REGION 1..521: note = Orthologs of terminal deoxynucleotidyl transferase
MHHHHHHGGSGMDPLQAVHLGPRKKRPRQLGTPVASTPYDIRFRDLVLFILEKKMGTTRRAFLMELARRKGFRVENELSDSVTHIVAENNSGSDVLEWLQLQNIKASSELELLDISWLIECMGAGKPVEMMGRHQLVVNRNSSPSPVPGSQNVPAPAVKKISQYACQRRTTLNNYNQLFTDALDILAENDELRENEGSCLAFMRASSVLKSLPFPITSMKDTEGIPCLGDKVKSIIEGIIEDGESSEAKAVLNDERYKSFKLFTSVFGVGLKTAEKWFRMGFRTLSKIQSDKSLRFTQMQKAGFLYYEDLVSCVNRPEAEAVSMLVKEAVVTFLPDALVTMTGGFRRGKMTGHDVDFLITSPEATEDEEQQLLHKVTDFWKQQGLLLYCDILESTFEKFKQPSRKVDALDHFQKCFLILKLDHGRVHSEKSGQQEGKGWKAIRVDLVMCPYDRRAFALLGWTGSRQFERDLRRYATHERKMMLDNHALYDRTKRVFLEAESEEEIFAHLGLDYIEPWERNA

SEQ ID NO: 3603 - DNA, 1587 bp, synthetic construct
  misc_feature 1..1587: note = Orthologs of terminal deoxynucleotidyl transferase
  source 1..1587: mol_type = other DNA
atgcaccatcatcatcatcatggcggtagcggcatgcaccgcattcgtaccatcgattcggacttcgggaagaaacgccagaagaagatggataaccacattagttccatgatctatgaaatcaaatttcacgagtttgtgctgttcattctcgaaaagaaaatgggtgcgacgcgtcgtacttttctgacagatttagcccgcaagaaagggttccgcgtcgagaatgaactgtcaaacagcgttacccacatcgtggcagaaaataattcaggatctgacgtattggcttggctgaagacccacaagatggagaaaacgacgcaatttgaactgctggatattagctggcttatcgaatgcatgaaagttggtaaaccggtggacaccaaagggaaataccagttgatggaatcgcgtgtcgatagtgcgaacccagatccgacagccggtaccctcaacattctgcctcctactacgaagaccatttctcagtatgcgtgtcaacgccgcaccaccatcaacaaccataatcagcgttttacggacgcattcgaaattcttgcgaagaattacgagttcaaagaaaacgatgatacttgcctgacctttatgcgtgctatttccgtgctgaaatgtcttccgtttgaggtagttagcctgaaagacacggaaggattgccctggatcggtgatgaagtcaaagggattatggaagaaatcatcgaggacggtgaatcgctggaagtgcaggccgtgctcaatgatgagcgctatcaaagcttcaaactgtttaccagtgtctttggagtggggctgaagacagcagacaaatggtaccgtatgggtttccgcacgctcaacaagattcgttccgataagaccctgaaattgaccaagatgcagaaagcgggtctgtgctattatgaagatcttattgattgtgtttcaaaagccgaagctgacgcggtatctctgctggttcaggatgcagtctggactttcttgccggatgcgctggtgactattacgggtggatttcgtcgtgggaaagagtttggtcacgacgttgatttccttatcacatctccgggagctgagaaagaacaagaagaccagctcctgcagaaagtgaccaatctgtggaagaaacaagggttgttgctgtactgcgatctgatcgaaagcacctttgaagatctgaaactcccatcccgcaagattgatgccctggaccatttccagaaatgctttctgatcctcaaactttatcaccataaagaggacaaacgcaaatgggaaatgccgacgggttcgaacgaaagcgaggccaaaagttggaaagcaattcgcgtagatctggttgtttgtccctacgatcgttatgcgtttgcgttgttgggttggagtggaagccgccaattcgaacgtgatctgcgccgctacgccacccacgagaagaagatgatgctggacaatcatgcgctgtatgacaagaccaagaaaatctttctcaaagctaaatcggaagaggaaattttcgcacatctggggcttgaatacattcagccgtccgaacgtaacgca

SEQ ID NO: 3604 - protein, 529 aa, synthetic construct
  REGION 1..529: note = Orthologs of terminal deoxynucleotidyl transferase
MHHHHHHGGSGMHRIRTIDSDFGKKRQKKMDNHISSMIYEIKFHEFVLFILEKKMGATRRTFLTDLARKKGFRVENELSNSVTHIVAENNSGSDVLAWLKTHKMEKTTQFELLDISWLIECMKVGKPVDTKGKYQLMESRVDSANPDPTAGTLNILPPTTKTISQYACQRRTTINNHNQRFTDAFEILAKNYEFKENDDTCLTFMRAISVLKCLPFEVVSLKDTEGLPWIGDEVKGIMEEIIEDGESLEVQAVLNDERYQSFKLFTSVFGVGLKTADKWYRMGFRTLNKIRSDKTLKLTKMQKAGLCYYEDLIDCVSKAEADAVSLLVQDAVWTFLPDALVTITGGFRRGKEFGHDVDFLITSPGAEKEQEDQLLQKVTNLWKKQGLLLYCDLIESTFEDLKLPSRKIDALDHFQKCFLILKLYHHKEDKRKWEMPTGSNESEAKSWKAIRVDLVVCPYDRYAFALLGWSGSRQFERDLRRYATHEKKMMLDNHALYDKTKKIFLKAKSEEEIFAHLGLEYIQPSERNA

SEQ ID NO: 3605 - DNA, 1536 bp, synthetic construct
  misc_feature 1..1536: note = Orthologs of terminal deoxynucleotidyl transferase
  source 1..1536: mol_type = other DNA
atgcaccatcatcatcatcatggcggtagcggcatgaatcatgcgggtatgctggcactcgtgaagaaacgtaaacgcccggttgaagctggagcacagggacaagtcgaggtgaagtttaaagaagtaaccctggaattggttgagcgcaagatgggcagttcgcgtcgtaacttcttaacgcgccttgcgcgctccaaagggtttcgtgtggaagatgtcctgtcagacgacgttactcacgtggtggccgaagataaccaggccgaagtattatgggcgtggctgatggggcacggtctgcgcgatgtctctcgtctggctttgctcgacattagctggttcaccgatagtatgcgtgagggtcgtccagttcgcgtagaaacgcgccacagcatccagaatacacctaccgggaccgattgctcaccgccgactgccgttgcaaacgtgtcgcaatatgcttgtcagcgccgtacgacgaccgagaatcacaacaacaagatttttaccgatgtcatggaagaactggcggaatcttccgagttcaatgaaagcaaaggaccctgccttgcgtttcgtcaagccgcctccgtgctgaaaagcttaccgagtgcagttcactgtctgaaagctatccagggtttgccatgcctcggtgaacacacaaaagcagtgatggaggagattcttacctttgggcgcagcttcaaagtcgaagaaatccgctgtgacgaacgttaccaggccttgaaattatttacgtctgtgttcggtgtaggaccgaagaccgcagagaaatggtatcgccgtgggctccgctcgcttcaggaaattttgactgaacctaacatccaactcaatcgtatgcagcgtgccggttttctttactactcggatatttccaaagctgtcagcaaagccgaagcaaaagctgttgggtgcatcatcgaagataccttccattggattgcaccggacgccattttagccttaacgggtggttttcgtcgtggaaaagagtatgggcatgatgtggacttcttgttgactatgccggagatcggaaaagatgaaggtttacttcttcacgtgattgatcgtctcaaagaccagggtatcctcctctattgcgattatcaaggaagtacctttgacgtctcaaaattgccctcttgtcgcttcgaagatatggattgctttcagaagtgtttccttatcttacgcttggaacaaggtcaggttgaaggtgaacgtgggttacagcgcgatccaggagatagtcgtggttggcgtgctgtacgcgttgacttagtagcacctccggtcgatcgctacgcttttgcactcttggggtggactgggagccgttttggtcgtgatttgcgcaccttcgcccagaaagaacgccagatgctcctcgacaaccatgccctttatgacaagacaaagaaattgtgccttttagctacgacggaggaggacatttttacccatcttggtttggaatacgttgaaccgtggcaacgcaatgca

SEQ ID NO: 3606 - protein, 512 aa, synthetic construct
  REGION 1..512: note = Orthologs of terminal deoxynucleotidyl transferase
MHHHHHHGGSGMNHAGMLALVKKRKRPVEAGAQGQVEVKFKEVTLELVERKMGSSRRNFLTRLARSKGFRVEDVLSDDVTHVVAEDNQAEVLWAWLMGHGLRDVSRLALLDISWFTDSMREGRPVRVETRHSIQNTPTGTDCSPPTAVANVSQYACQRRTTTENHNNKIFTDVMEELAESSEFNESKGPCLAFRQAASVLKSLPSAVHCLKAIQGLPCLGEHTKAVMEEILTFGRSFKVEEIRCDERYQALKLFTSVFGVGPKTAEKWYRRGLRSLQEILTEPNIQLNRMQRAGFLYYSDISKAVSKAEAKAVGCIIEDTFHWIAPDAILALTGGFRRGKEYGHDVDFLLTMPEIGKDEGLLLHVIDRLKDQGILLYCDYQGSTFDVSKLPSCRFEDMDCFQKCFLILRLEQGQVEGERGLQRDPGDSRGWRAVRVDLVAPPVDRYAFALLGWTGSRFGRDLRTFAQKERQMLLDNHALYDKTKKLCLLATTEEDIFTHLGLEYVEPWQRNA

SEQ ID NO: 3607 - DNA, 1554 bp, synthetic construct
  misc_feature 1..1554: note = Orthologs of terminal deoxynucleotidyl transferase
  source 1..1554: mol_type = other DNA
atgcaccatcatcatcatcatggcggtagcggcatgaatccgctgtctcagtcggcgttggtgccactgcgtaagaaagcgaaaatggcaccgatttcccaaagcttctgccagcacaacgtcaaatttaaagaaatcgtactctttctggttgagcgcaagatgggcagtagtcgtcgtaccttccttatggaactggctcgcaaacgcggctttcagacggaaattgagctgagcgattcggtgactcacatcgttgcggaaaacaactctggcgccgaagtgttagagtggctgcagtccaagaaattggggttcaccgtcaagacacacattctggacatcagctggtttaccgagtgtatggaagcaggtcgtcccgtggaaatccaaaatcgccacctcttacctgttcagcaggattgctctgcgaattttaacccgccgctgtcatcgtcatgtgtccaagtgagccagtatgcttgccaacgctgtacgacgcttcaggataccaaccgtattttcactgacgccttcgatattctggcggaacactttgaattctgcgagaataaaggccgtaccgtagcatttttacgcgcgagttccctgatcaaaagcctgccattcccgattacagccatgaaagaacttgaagggttgccttggctgggtgaccagatgaaaggcattatcgaagaaattctggaagagggcaagtcgtacaaagttctggaagtgatgaacgaagagcgctataaatcctttaaacaatttaccagtgtctttggtgtaggactgaagacgagcgataaatggttccgtatgggctttcgcaccctggaagaaatcaagaacgagaaagaactcaaactgacgaagatgcagaaatgcggtctcctgtactacgaagatattacctcgtatgtgtcacgtgctgaagcggaaacaactgagcagctgatcaaaagcattgtctggaaattcgttccggacgccatcgtgaccttgactggtgggtttcgccgcggcaagaagaaaggccatgatgtggacattttgattacctgtgcacgtaaagggaaagagaagaatatcctgcacaatacgatgtcagttttgaaaaaccgtggtctgcttctgttctataatatcattgaatccacctttgatgaaacgaaactgccctctcgccatgtagatgcgcttgaccacttccagaaatgctttaccatcctgaaattgccgaaacgtcaaatggatattggcaacattatcgatccacatgaatgtgaacgcaagaattggaaagccgttcgtcttgacctggtgattactccgtatgagcaatacccttatgcactgctcggatggacaggtagtcgccagtttgaacgtgatctgcgccgctacgcgacccatgagaaacgtatgatgctggataaccacggcctctatgacaagacgaagaataatttcttgaaagctaacaacgaagaagatatctttaaacagctgggtcttgactacttggaaccgtgggaacgtaacgct

SEQ ID NO: 3608 - protein, 518 aa, synthetic construct
  REGION 1..518: note = Orthologs of terminal deoxynucleotidyl transferase
MHHHHHHGGSGMNPLSQSALVPLRKKAKMAPISQSFCQHNVKFKEIVLFLVERKMGSSRRTFLMELARKRGFQTEIELSDSVTHIVAENNSGAEVLEWLQSKKLGFTVKTHILDISWFTECMEAGRPVEIQNRHLLPVQQDCSANFNPPLSSSCVQVSQYACQRCTTLQDTNRIFTDAFDILAEHFEFCENKGRTVAFLRASSLIKSLPFPITAMKELEGLPWLGDQMKGIIEEILEEGKSYKVLEVMNEERYKSFKQFTSVFGVGLKTSDKWFRMGFRTLEEIKNEKELKLTKMQKCGLLYYEDITSYVSRAEAETTEQLIKSIVWKFVPDAIVTLTGGFRRGKKKGHDVDILITCARKGKEKNILHNTMSVLKNRGLLLFYNIIESTFDETKLPSRHVDALDHFQKCFTILKLPKRQMDIGNIIDPHECERKNWKAVRLDLVITPYEQYPYALLGWTGSRQFERDLRRYATHEKRMMLDNHGLYDKTKNNFLKANNEEDIFKQLGLDYLEPWERNA

SEQ ID NO: 3609 - DNA, 1560 bp, synthetic construct
  misc_feature 1..1560: note = Orthologs of terminal deoxynucleotidyl transferase
  source 1..1560: mol_type = other DNA
atgcaccatcatcatcatcatggcggtagcggcatggaccctctgtgtaccgcgagttctgggccacgcaagaaacgtccgcgtcaggtgggcgcatcaatggcctcgccgcctcacgacatcaaatttcaaaacctcgtcctgttcattctggaaaagaaaatgggtactactcgccgcaattttttaatggagctggcgcgtcgtaaaggattccgcgtggaaaacgaattgtccgatagcgttacgcacattgtagccgagaataatagcgggagtgaagttcttgaatggttacaggtgcagaacatccgtgcttcgtcgcaactggaactgctggatgtctcatggctcattgagtctatgggtgcaggtaaacccgtggaaatcaccgggaaacaccagttggttgtacgcacagactatagtgctaccccgaacccaggttttcagaaaaccccgccgctggcggtcaagaagattagccaatacgcatgccagcgcaagacgacgctgaacaactataatcacatcttcaccgatgcctttgaaattcttgcggagaattccgagttcaaagaaaacgaagtgagctacgtgacctttatgcgtgcggcgtccgttctgaaaagcctgccttttacgatcatctccatgaaagacactgaaggaattccgtgcctgggtgataaagtcaagtgtattattgaggaaatcatcgaagatggagaatcgtctgaggttaaagccgtgttgaatgacgaacgctatcagagcttcaaactctttacctcagtctttggtgtggggctgaagacaagcgagaaatggttccgtatggggtttcgctcgctttccaagattatgagcgataagacgctgaaattcaccaagatgcagaaagctggtttcttgtactacgaagatctggtatcttgcgttacccgtgccgaagcagaagcggtgggagtcctggtaaaagaagcagtctgggcttttttaccagacgcgtttgtgacaatgacgggtggttttcgtcgcgggaagaagattgggcacgatgtggacttccttatcacctctcctggaagtgcagaggatgaagaacaattactcccgaaagtcattaacctgtgggagaagaaaggtctgctgctgtattatgatttggtggaaagcactttcgagaaatttaaattaccgagtcgccaagttgacaccctcgatcatttccagaaatgttttctgatcctgaaattacatcaccagcgtgtagattcatcgaaatccaatcaacaggaaggtaagacgtggaaagcgattcgcgttgacttggtaatgtgcccctatgaaaaccgtgcctttgcattacttggatggaccgggagtcgccagttcgaacgtgatattcgtcgttacgcgactcatgagcgcaagatgatgctggacaatcacgccctgtatgataagacaaaacgcgtgtttctcaaagctgaaagcgaagaagagatctttgcgcatcttggtctggattacattgaaccatgggaacgcaacgca

SEQ ID NO: 3610 - protein, 520 aa, synthetic construct
  REGION 1..520: note = Orthologs of terminal deoxynucleotidyl transferase
MHHHHHHGGSGMDPLCTASSGPRKKRPRQVGASMASPPHDIKFQNLVLFILEKKMGTTRRNFLMELARRKGFRVENELSDSVTHIVAENNSGSEVLEWLQVQNIRASSQLELLDVSWLIESMGAGKPVEITGKHQLVVRTDYSATPNPGFQKTPPLAVKKISQYACQRKTTLNNYNHIFTDAFEILAENSEFKENEVSYVTFMRAASVLKSLPFTIISMKDTEGIPCLGDKVKCIIEEIIEDGESSEVKAVLNDERYQSFKLFTSVFGVGLKTSEKWFRMGFRSLSKIMSDKTLKFTKMQKAGFLYYEDLVSCVTRAEAEAVGVLVKEAVWAFLPDAFVTMTGGFRRGKKIGHDVDFLITSPGSAEDEEQLLPKVINLWEKKGLLLYYDLVESTFEKFKLPSRQVDTLDHFQKCFLILKLHHQRVDSSKSNQQEGKTWKAIRVDLVMCPYENRAFALLGWTGSRQFERDIRRYATHERKMMLDNHALYDKTKRVFLKAESEEEIFAHLGLDYIEPWERNA

SEQ ID NO: 3611 - DNA, 1563 bp, synthetic construct
  misc_feature 1..1563: note = Orthologs of terminal deoxynucleotidyl transferase
  source 1..1563: mol_type = other DNA
atgcaccatcatcatcatcatggcggtagcggcatgtatgcgtttccgaccacccgtattgccccacgccgcaaacagccgaagtgcatcaaacctcccaaatgtacgtcgaaatacgatatcaagttcaaagacattgcaatctatattctggaacgtaagatgggagctagtcgccgctactttttaatggagctggcgcgtaagaaaggcttccgtgtggaaccggatttgtccgaatacgtcactcacgttgtttctgagaagaactcaggcgccgaagtactggaatggctccaagcgaagaaagcagggagcatcccaaatgtggccattctggacatttcgtggtttacggattgcatgggtgcaggccagccggtggaaatcgagcgtaaacaccgccttaccctgcagaagatttgtgtctgcaaaagccctagtccggtagttccgtctcgcgtgggtgtgtcgcaatatgcgtgtcagcgcaagacaacactggataacaagaataccttgttcactgacgcgtttgaaatcctggctgagaactatgaattccgtgaaaatgaacgttcctgcctcagctttcgtcaagccgcctcagtcctgaaaagccttacgtttaccattgctgggatggcggatgttgatggcttaccgggtttcggcgaccacattcgcgcagtgatcgaggatctgattgaagatggagaatcctccaaagtcagtgaggtactgaacgacgaagtgtatcgcagcctgaaattgtttaccaccatcttcggtgttggcttacgtactgctgagaaatggcatcgcctggggattcgtacgctcgaagaaatcaaaagtaatgaaaacctgaaattctcgaagatgcagattgcgggccttcagcactacgaggatatcttaggaggtgtgcgcaaagcagaagcggatgccgttgcgatggtcgtccgtgacgccgtgtggacgtttctgccagatgcagtagttaccctgaccggtggttttcgtcgcgggaacaaaacaggccatgacgtggatatgctcattactagccccattcagggcaaagagaaagaactgctgcacaaagtgatcaatctgtggaagaaacaagacttgcttttgtgtcatacgattcacgaatcaaccatggatgaagataacctgccgtcgaaaagcgttaatttactggaccattttcagaaatgcttcgcgatcctgaaatcaaaccaacatcgcggcgaaattagtagttgcgatggtcctcacgattcccgtgagcgcggcaaacgtatctggaaagccattcgcgtagacctcgtcttctgtccgtttgaacagtatgcttttgcgttgttaggatggaccggtagccgtcagtttgaacgcgatctgcgtcgttacgcaagccacgagaagaagatgatgatcgacaatcatgccctgtatgataagacgaaacgcgtgttcgtgaaatgcgaatccgaagaggagatttttggtcatctgggtctggaatacatcgatccggttgaacgtaacgct

SEQ ID NO: 3612 - protein, 521 aa, synthetic construct
  REGION 1..521: note = Orthologs of terminal deoxynucleotidyl transferase
MHHHHHHGGSGMYAFPTTRIAPRRKQPKCIKPPKCTSKYDIKFKDIAIYILERKMGASRRYFLMELARKKGFRVEPDLSEYVTHVVSEKNSGAEVLEWLQAKKAGSIPNVAILDISWFTDCMGAGQPVEIERKHRLTLQKICVCKSPSPVVPSRVGVSQYACQRKTTLDNKNTLFTDAFEILAENYEFRENERSCLSFRQAASVLKSLTFTIAGMADVDGLPGFGDHIRAVIEDLIEDGESSKVSEVLNDEVYRSLKLFTTIFGVGLRTAEKWHRLGIRTLEEIKSNENLKFSKMQIAGLQHYEDILGGVRKAEADAVAMVVRDAVWTFLPDAVVTLTGGFRRGNKTGHDVDMLITSPIQGKEKELLHKVINLWKKQDLLLCHTIHESTMDEDNLPSKSVNLLDHFQKCFAILKSNQHRGEISSCDGPHDSRERGKRIWKAIRVDLVFCPFEQYAFALLGWTGSRQFERDLRRYASHEKKMMIDNHALYDKTKRVFVKCESEEEIFGHLGLEYIDPVERNA

SEQ ID NO: 3613 - DNA, 1539 bp, synthetic construct
  misc_feature 1..1539: note = Orthologs of terminal deoxynucleotidyl transferase
  source 1..1539: mol_type = other DNA
atgcaccatcatcatcatcatggcggtagcggcatggatctgctgcaggcgccgcattcaggcccacgcaagaaacgtccgcgtaaagcaggagccttgatggtgtccggcgctcacgaagttcgctttggtgaccttgtcctgttcattcttgaaaagaaaatggggagtacccgtcgtgcgtttctgatggatttagcccgctcgaaagtgatgctgttgcctcaccttgtagcggaaaacaacagcggcaatgatgttctggaatggctccaagtgcagaatatccaggcatcgtcgcgcctggagctgttagacgtatcttggctgatcgaatgcatgggtgctgggaaaccggtcgaaatgacgcgcaaacaccaattggtggttcgtcgtggctcacccgcctctccgaacccagatgcgcagaagactccgagtcgctccgtccagcgcattagcgagtatgcatgtcaacgtcgtaccaccctgaacaactgcaattacgccttcacaaatgcgtttgaaattctggctgaaaactgtgagttcaaagaaaatgaagacagctatgtgacgtacatccgcgcagcgtctgttctcaaaagcctgccgtttaccattatttccatgaaagatactgaaggtatcccttgcttaggcgatcgcgtgaaatgtatcatcgaggagattattgaagacggagaaagtagtgaagtaaatgccgtcctgaacgatgagcgctataaaagctttaagctgttcacgtccgtgtttggcgttggtctcaagacctcggagaaatggttccgtatggggtttcgtagcctgaacaagattaaatcagacaaaagcttgaaattcacacgcatgcagaaagcgggctttctttactacgaagatttagtgtcatgcgtaacccgtgcagaagccgaagctgtgtctacgctggtcaaagaagcggtttgggcgtttttacccggtgccttcatctctatgactggcggctttcgccgcgggaaagaaattggacacgatgtcgacttcctgatcaccagtccggaaattacggaggatgaagaacagcaggtgctgcataaagttatcaatttgtgggagaacaaaggtctgctgctgtatagcgatcttgtggaatcgacctttgagaaattgaagttaccatcccgtaaagttgacgcgctggatcactttcaaaaatgtttcctcattctgaaactgcatcatcaacgtgaagacaatgaaaagagctcacagcaggaagagaagacatggaaagcaatccgcgtcgatcttgtaatgtgcccgtatgaacgtcgtgcttttgccctgttaggttggaccggctcgcgccaattcgaacgcgatctgcgtcgttatgcaactcacgagcgcaagatgatgctcgataaccatgcgctgtacgacaagacgaaacgcatttttttgaaagccgaatccgaagaagaaattttcgcgcacctgggcctggattatatcgagccttgggaacgcaatgct

SEQ ID NO: 3614 - protein, 513 aa, synthetic construct
  REGION 1..513: note = Orthologs of terminal deoxynucleotidyl transferase
MHHHHHHGGSGMDLLQAPHSGPRKKRPRKAGALMVSGAHEVRFGDLVLFILEKKMGSTRRAFLMDLARSKVMLLPHLVAENNSGNDVLEWLQVQNIQASSRLELLDVSWLIECMGAGKPVEMTRKHQLVVRRGSPASPNPDAQKTPSRSVQRISEYACQRRTTLNNCNYAFTNAFEILAENCEFKENEDSYVTYIRAASVLKSLPFTIISMKDTEGIPCLGDRVKCIIEEIIEDGESSEVNAVLNDERYKSFKLFTSVFGVGLKTSEKWFRMGFRSLNKIKSDKSLKFTRMQKAGFLYYEDLVSCVTRAEAEAVSTLVKEAVWAFLPGAFISMTGGFRRGKEIGHDVDFLITSPEITEDEEQQVLHKVINLWENKGLLLYSDLVESTFEKLKLPSRKVDALDHFQKCFLILKLHHQREDNEKSSQQEEKTWKAIRVDLVMCPYERRAFALLGWTGSRQFERDLRRYATHERKMMLDNHALYDKTKRIFLKAESEEEIFAHLGLDYIEPWERNA

SEQ ID NO: 3615 - DNA, 1563 bp, synthetic construct
  misc_feature 1..1563: note = Orthologs of terminal deoxynucleotidyl transferase
  source 1..1563: mol_type = other DNA
atgcaccatcatcatcatcatggcggtagcggcatggacccactgcaggcggtgcacttaggcccacgcaagaaacgtccgcgtcaaaccggtgcaagtggagcttctacgcctcacgacattcgctttcgtgatctggtcttgttcatcctggaaaagaagatgggcactactcgtcgtgcctttcttatggagctggcacgccgcaaagggttccgcgttgaaaacgaactgtccgattcagtgacccacattgtagcggagaataattcgggaagcgacgttctcgaatggctgcagctccagaacatcaaagcgagtagtgaatttgagttgctggatatttcctggcttatcgaatgcatgggtgcggggaaaccggtggaaatggctggtcgccaccaattagtcgtccgtcgtaacccctctctgagtccggttccaggcagccagacagtacctcctccgcccatgcagaagatttcccaatatgcatgtcagcgtcgcaccaccctgaataatcacaaccagctgtttacggatgcgttcgacatcttggccgagaactacgaatttcgcgaaaacgaagtgtcatgccttccattcatgcgtgcggcgtcggtgctgaaaagcttaagttttccgattgttagcatgaaagatatcgaaggcattccatgtctgggcgacaaagtgaaatgcgtcattgagggcatcatcgaagatggtgagtcttcagaagtaaaagccgtgctgaatgatgaacgctataaatccttcaaactctttacgagtgttttcggcgtggggctgaagaccgctgagaaatggtttcgcatgggttttcgtacactgtcgaagattaaaagcgacaaaagcttacgtttcacccatatgcagaaagcaggcttcctctactacgaagatttggtctcgtgtgttaatcgcgccgaagcggaagccgtgtctatgctggtaaaagaggcagttgttgcttttcttcccgacgcgttggtcacgatgaccggtggttttcgtcgtggcaagatgactgggcacgatgtggatttcctgattaccagtcctgaagcgacggaagaagaagagcaacaactgctgcataaagtgaccaacttctggcgtcagcagggcctgctgctgtattgcgacatcatcgagagcacgtttgagaaatttaaattgccatcacgcaaagtagatgccctcgaccattttcagaaatgtttcctgattcttaaattacaccgcggattagtccgctccgaagaatctggccaacaagaagggaaggattggaaagcaattcgcgtggatctggttatgtgcccctatgaacgtcgtgcgtttgctttattgggttggacaggttcacgccagttcgaacgcgatctgcgtcgttatgccactcatgagcgcaagatgatgctggacaaccacgcgctctacgacaagaccaaacgcgtgtttctggaagcagaaagcgaggaggaaatctttgcccatcttggcctggattatattgaaccttgggaacgcaatgct

SEQ ID NO: 3616 - protein, 521 aa, synthetic construct
  REGION 1..521: note = Orthologs of terminal deoxynucleotidyl transferase
MHHHHHHGGSGMDPLQAVHLGPRKKRPRQTGASGASTPHDIRFRDLVLFILEKKMGTTRRAFLMELARRKGFRVENELSDSVTHIVAENNSGSDVLEWLQLQNIKASSEFELLDISWLIECMGAGKPVEMAGRHQLVVRRNPSLSPVPGSQTVPPPPMQKISQYACQRRTTLNNHNQLFTDAFDILAENYEFRENEVSCLPFMRAASVLKSLSFPIVSMKDIEGIPCLGDKVKCVIEGIIEDGESSEVKAVLNDERYKSFKLFTSVFGVGLKTAEKWFRMGFRTLSKIKSDKSLRFTHMQKAGFLYYEDLVSCVNRAEAEAVSMLVKEAVVAFLPDALVTMTGGFRRGKMTGHDVDFLITSPEATEEEEQQLLHKVTNFWRQQGLLLYCDIIESTFEKFKLPSRKVDALDHFQKCFLILKLHRGLVRSEESGQQEGKDWKAIRVDLVMCPYERRAFALLGWTGSRQFERDLRRYATHERKMMLDNHALYDKTKRVFLEAESEEEIFAHLGLDYIEPWERNA

SEQ ID NO: 3617 - DNA, 1494 bp, synthetic construct
  misc_feature 1..1494: note = Orthologs of terminal deoxynucleotidyl transferase
  source 1..1494: mol_type = other DNA
atgcaccatcatcatcatcatggcggtagcggcatgctgccgagtcgcaaacgcgttcgcgctgaagtttctacctcacagggcggcgagcacgtcaagttttccgatgtgacgttgttcctggttgagaaacgcatgggcaaatcgcgtcgcacctttttaagctctcttgcccgctccaaaggtttctgcgttgacgacgctctgagcggcgcagtaactcacgtggtcagtgaagggctgagtgcgcaagatttatggctctggctggaagatcaggggtttcaggaaacacactcgaaacacgtgctgaacattagctggttcaccgaatcaatgagcgcaggccgtccactgccggtagaagatacgcactgtatccaaaatcctgccgccgaccagcgctcatgcgtgcatctttcggctactccggagtctgcggttagtccctatgcatgtcagcgtcgtaccaccttggaaaaccacaataagatttttacggaagcgctggaggtcctcgcgctgaactccgaatttagcggtaatcaaggttcatgcctgggttttcgccgcgctgccagcgtgttgaaatctttaccggcagcgctgcgttcgccagaagaagccctgcgcctcccgtgtctgggcgataactcgcgtgcggtcttggaggagatctgcgaatgtggtagctcaagtcgcgtggaagagattcagaatgatcaacgttaccgcaccatgaaacttttctgctctgtattcggcgttgggcctaagacagcagaaagctggttttgccgtggcctgaaaacgttcgaacaggtgttaactgaaccgtccatccgtctgaaccgcatgcagaccgccggttttctgttctatgaagacatttctgttcccgtatcacgcgcggaagctgccgcgctcaagatgatgatggaggaggcactgctgtttatcaatccgagtgcgacggtcaccattaccggcggctttcgtcgtgggaaagaattcggtcatgatgtggactttatcatcaaagccccagaaggacaagaagatcgcattcttccggctgtcattaaacgcttcaaaagccagaacgtgctgttgtactcggattttcagaaaagcacttttgacttacgtcaactgcctaaccatcgcttcgaggcgatggatcgctttagcaaatgtttcctgctggttaaattgcagatgcaggaaagtcgtacgggtcgtaattggcgcgcagtgcgtgttgatctcgtagcgccgccgcttgaacgcttcccatatgccttattaggctggacaggttcgaccctgtttgagcgtgacttgcgccgctttgctcgtctcgaacgtggcaagctgctggataaccacaccctgtacgacaaaacgacgaaaacctttcttccggcgaatactgaggaggatattttccaacatctggggctggaatatatcgaaccttggcagcgtaacgca

SEQ ID NO: 3618 - protein, 498 aa, synthetic construct
  REGION 1..498: note = Orthologs of terminal deoxynucleotidyl transferase
MHHHHHHGGSGMLPSRKRVRAEVSTSQGGEHVKFSDVTLFLVEKRMGKSRRTFLSSLARSKGFCVDDALSGAVTHVVSEGLSAQDLWLWLEDQGFQETHSKHVLNISWFTESMSAGRPLPVEDTHCIQNPAADQRSCVHLSATPESAVSPYACQRRTTLENHNKIFTEALEVLALNSEFSGNQGSCLGFRRAASVLKSLPAALRSPEEALRLPCLGDNSRAVLEEICECGSSSRVEEIQNDQRYRTMKLFCSVFGVGPKTAESWFCRGLKTFEQVLTEPSIRLNRMQTAGFLFYEDISVPVSRAEAAALKMMMEEALLFINPSATVTITGGFRRGKEFGHDVDFIIKAPEGQEDRILPAVIKRFKSQNVLLYSDFQKSTFDLRQLPNHRFEAMDRFSKCFLLVKLQMQESRTGRNWRAVRVDLVAPPLERFPYALLGWTGSTLFERDLRRFARLERGKLLDNHTLYDKTTKTFLPANTEEDIFQHLGLEYIEPWQRNA

SEQ ID NO: 3619 - DNA, 1170 bp, synthetic construct
  misc_feature 1..1170: note = Orthologs of terminal deoxynucleotidyl transferase
  source 1..1170: mol_type = other DNA
atgcaccatcatcatcatcatggcggtagcggcagcccgagtccggttccgggtagccagaatgttccggcaccggcagtgaaaaaaatcagccagtatgcatgtcagcgtcgtaccacactgaataactataatcagctgtttaccgatgcgctggatattctggcagaaaatgatgaactgcgtgaaaatgaaggtagctgtctggcatttatgcgtgcaagcagcgttctgaaaagcctgccgtttccgattaccagcatgaaagataccgaaggtattccgtgtctgggtgataaagtgaaaagcattattgaaggcatcatcgaagatggtgaaagcagcgaagcaaaagcagttctgaacgatgaacgttacaaaagcttcaaactgtttaccagcgtttttggtgttggtctgaaaaccgcagaaaaatggtttcgtatgggttttcgtaccctgagcaaaattcagagcgataaaagtctgcgttttacccagatgcagaaagcaggttttctgtattatgaagatctggtgagctgtgttaatcgtccggaagccgaagcagttagcatgctggttaaagaagcagttgttacctttctgccggatgcactggttaccatgaccggtggttttcgtcgtggcaaaatgacaggtcatgatgtggattttctgattacctcaccggaagcaaccgaagatgaagaacagcaactgctgcataaagttaccgatttttggaaacagcagggtctgctgctgtattgtgatatcctggaaagcaccttcgagaaattcaaacagccgagccgtaaagttgatgccctggatcattttcagaagtgttttctgatcctgaaactggatcatggtcgtgttcatagcgaaaaaagcggtcagcaagaaggtaaaggttggaaagcaattcgtgttgatctggttatgtgtccgtatgatcgtcgtgcatttgcactgttaggttggaccggtagccgtcagtttgaacgtgatctgcgtcgttatgcaacccatgaacgtaaaatgatgctggataatcatgcactgtatgatcgcaccaaacgtgtttttctggaagcagaaagcgaagaagaaatctttgcacatctgggccttgattacattgaaccgtgggaacgtaatgca

SEQ ID NO: 3620 - protein, 390 aa, synthetic construct
  REGION 1..390: note = Orthologs of terminal deoxynucleotidyl transferase
MHHHHHHGGSGSPSPVPGSQNVPAPAVKKISQYACQRRTTLNNYNQLFTDALDILAENDELRENEGSCLAFMRASSVLKSLPFPITSMKDTEGIPCLGDKVKSIIEGIIEDGESSEAKAVLNDERYKSFKLFTSVFGVGLKTAEKWFRMGFRTLSKIQSDKSLRFTQMQKAGFLYYEDLVSCVNRPEAEAVSMLVKEAVVTFLPDALVTMTGGFRRGKMTGHDVDFLITSPEATEDEEQQLLHKVTDFWKQQGLLLYCDILESTFEKFKQPSRKVDALDHFQKCFLILKLDHGRVHSEKSGQQEGKGWKAIRVDLVMCPYDRRAFALLGWTGSRQFERDLRRYATHERKMMLDNHALYDRTKRVFLEAESEEEIFAHLGLDYIEPWERNA

SEQ ID NO: 3621 - DNA, 1170 bp, synthetic construct
  misc_feature 1..1170: note = Orthologs of terminal deoxynucleotidyl transferase
  source 1..1170: mol_type = other DNA
atgcaccatcatcatcatcatggcggtagcggcagcctgagcccggtgccgggtagccaaaccgttccaccgccgctgatgcagaagattagccagtatgcctgtcagcgtcgtaccactctgaataaccataaccagttgttcaccgatgcatttgatatcctggcggagaactatgaattccgcgaaaatgaagtctcttgtctgccgttcatgcgtgctgctagcgttctgaaaagccttagctttccgattgtttctatgaaggatatcgagggtattccgtgcctgggcgataaagtaaaatgcgtaattgaaggcatcatcgaggacggtgagtcgtcggaggttaaagctgtcctgaatgatgaacgttacaagtccttcaaattatttacctcagtttttggggtgggtttgaagaccgcagaaaaatggtttaggatgggtttccgtacgctgtccaaaatcaaaagcgacaagagcctgcgcttcacgcacatgcagaaggctggctttctgtactacgaggacttggtgtcttgcgttaacagagcagaagcggaggcggtgtctatgttagtgaaggaggccgttgtagcgtttttgccagacgcgctggtcaccatgacgggcggtttccgccgcggtaagatgacgggccatgacgttgacttcctgatcacctccccggaagcgacggaagaggaagaacagcaattgctccacaaagttaccaatttttggcgtcaacaaggcctgctgctctactgcgatatcattgagtcgaccttcgaaaagtttaagctgccgagccgtaaggtggatgctctggatcattttcaaaagtgctttctgattttaaagttgcaccgcggtctcgtgcgtagcgaagaaagcggtcagcaagaaggtaaggactggaaagcgattcgtgttgacttggtcatgtgcccgtatgagcgtcgtgcgttcgccctgttgggttggaccggctctagacaatttgagcgtgatctgcgtcgctacgcaacccacgagcgcaaaatgatgctggacaaccacgcgctatacgataaaaccaaacgcgttttcctggaagccgagagcgaagaggaaatttttgcgcacctgggtctcgactatattgagccgtgggagcgtaacgca

SEQ ID NO: 3622 - protein, 390 aa, synthetic construct
  REGION 1..390: note = Orthologs of terminal deoxynucleotidyl transferase
MHHHHHHGGSGSLSPVPGSQTVPPPLMQKISQYACQRRTTLNNHNQLFTDAFDILAENYEFRENEVSCLPFMRAASVLKSLSFPIVSMKDIEGIPCLGDKVKCVIEGIIEDGESSEVKAVLNDERYKSFKLFTSVFGVGLKTAEKWFRMGFRTLSKIKSDKSLRFTHMQKAGFLYYEDLVSCVNRAEAEAVSMLVKEAVVAFLPDALVTMTGGFRRGKMTGHDVDFLITSPEATEEEEQQLLHKVTNFWRQQGLLLYCDIIESTFEKFKLPSRKVDALDHFQKCFLILKLHRGLVRSEESGQQEGKDWKAIRVDLVMCPYERRAFALLGWTGSRQFERDLRRYATHERKMMLDNHALYDKTKRVFLEAESEEEIFAHLGLDYIEPWERNA

SEQ ID NO: 3623 - DNA, 1167 bp, synthetic construct
  misc_feature 1..1167: note = Orthologs of terminal deoxynucleotidyl transferase
  source 1..1167: mol_type = other DNA
atgcaccatcatcatcatcatggcggtagcggcagtgatagtactaacccaggtccgccgaaaaccccacctatcgctgtgcagaagatttcacaatacgcatgtcagcgtcgtaccaccctcaacaactgcaatcagatctttacggatgccttcgacattcttgcggagaactgtgaatttcgcgagaatgaagatagctgcgtcacttttatgcgtgctgctagcgtgctgaaatccttacccttcacaatcatctccatgaaagataccgaagggattccgtgtttaggcagcaaagttaaaggcattattgaggagatcatcgaagacggagaatcgtcggaagtcaaagcggtgctgaacgatgaacgctatcagagctttaaactgttcacgtccgtgtttggtgttggcctgaagaccagtgagaaatggttccgtatgggttttcgcacgctgtctaaagtccgtagcgacaaatcgctcaaattcactcgcatgcaaaaagcagggtttctgtactacgaagatcttgtttcatgcgtgacacgtgcggaagcggaagcagtatccgtcctggttaaggaagcggtgtgggcgtttttgccggatgcattcgtgaccatgaccggcggttttcgccgcggcaagaagatgggtcacgacgttgatttcctgattacatcgcctggatctacggaggatgaagagcagctgctccagaaagtcatgaatctgtgggaaaagaaaggccttctgctgtattatgacttggtagaaagcacctttgagaaactgcgtttaccgagccgtaaagtggatgctctcgaccacttccagaaatgttttctgatttttaaattaccacgccaacgtgttgattcggatcaaagtagttggcaggaaggtaagacctggaaagcgatccgcgtggaccttgtattatgcccgtatgaacgtcgtgcgttcgcattattggggtggactggctcacgccagtttgagcgcgatttgcgtcgttacgctacgcatgaacgcaagatgattctcgataaccacgcgctttatgacaagaccaaacgcatcttcttgaaagcagaaagcgaagaggagatttttgctcatttaggcctcgattacattgaaccgtgggaacgcaatgca

SEQ ID NO: 3624 - protein, 389 aa, synthetic construct
  REGION 1..389: note = Orthologs of terminal deoxynucleotidyl transferase
MHHHHHHGGSGSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 3625 - DNA, 1158 bp, synthetic construct
  misc_feature 1..1158: note = Orthologs of terminal deoxynucleotidyl transferase
  source 1..1158: mol_type = other DNA
atgcaccatcatcatcatcatggcggtagcggctacccgaccctgaagaccccggaatccgaggtctcctcgttcactgcgtccaaagtttcgcaatacagctgtcagcgtaaaacgaccttaaataactgcaacaaaaagttcacggatgcgtttgagatcatggcggagaactatgagttcaaagagaacgaaatcttctgcctggaattcctgcgtgcggcaagtgtgctgaagagcctgccgtttccggtgacgcgtatgaaagacatccagggtttaccgtgtatgggcgatcgtgttcgtgatgttattgaggaaatcatcgaagaaggtgaaagcagcagagcgaaagacgtgctgaatgatgaacgttataaaagctttaaagagttcacttcagttttcggcgttggcgtgaagacgagcgagaaatggtttcgtatgggtctgcgcaccgtagaagaggttaaggctgataaaaccttgaagcttagcaagatgcagcgtgcgggctttttgtactacgaggacctcgttagctgcgtttccaaggcggaggcagacgcggtttcttctatcgtgaagaacaccgtttgtacctttctgccggatgctctggtcacaattaccggtggtttccgccgtggtaaaaaaattggtcatgatattgattttctgattaccagcccgggtcaacgcgaagacgacgagttgctgcacaaaggcctgttgctgtactgcgatatcatcgaatccaccttcgtgaaagaacaaattccgagccgtcacgttgacgctatggatcactttcaaaaatgctttgcgattctgaagctgtaccagccgcgtgtcgacaactcctcgtacaatatgagcaagaagtgcgacatggccgaggttaaggactggaaagccatccgcgtggatctggttatcacgccgttcgagcaatacgcgtatgccttgctgggttggaccggtagccgccagtttggtcgtgatttgagacgttatgctacccacgagcgtaagatgatgctggacaatcatgcgctgtacgataagcgcaagcgtgtgtttttgaaggcaggcagcgaagaagagattttcgcgcatctgggtttggactatgttgagccttgggaacgtaatgct

SEQ ID NO: 3626 - protein, 386 aa, synthetic construct
  REGION 1..386: note = Orthologs of terminal deoxynucleotidyl transferase
MHHHHHHGGSGYPTLKTPESEVSSFTASKVSQYSCQRKTTLNNCNKKFTDAFEIMAENYEFKENEIFCLEFLRAASVLKSLPFPVTRMKDIQGLPCMGDRVRDVIEEIIEEGESSRAKDVLNDERYKSFKEFTSVFGVGVKTSEKWFRMGLRTVEEVKADKTLKLSKMQRAGFLYYEDLVSCVSKAEADAVSSIVKNTVCTFLPDALVTITGGFRRGKKIGHDIDFLITSPGQREDDELLHKGLLLYCDIIESTFVKEQIPSRHVDAMDHFQKCFAILKLYQPRVDNSSYNMSKKCDMAEVKDWKAIRVDLVITPFEQYAYALLGWTGSRQFGRDLRRYATHERKMMLDNHALYDKRKRVFLKAGSEEEIFAHLGLDYVEPWERNA

SEQ ID NO: 3627 - DNA, 1170 bp, synthetic construct
  misc_feature 1..1170: note = Orthologs of terminal deoxynucleotidyl transferase
  source 1..1170: mol_type = other DNA
atgcaccatcatcatcatcatggcggtagcggctctccaagtccggttccgggctcccagaacgtaccggcgcctgccgtgaagaagatttcacagtacgcgtgtcaacgtcgtaccaccctgaacaactataatcagctgtttacagacgctttggatatccttgcagagaatgatgaactgcgcgaaaacgaaggaagttgccttgcgttcatgcgcgcttcgagcgtcctgaaatccttgccctttccgattactagcatgaaagacacggagggtatcccatgtctgggcgacaaagtgaaaagcattattgaaggcatcatcgaagatggtgagagtagtgaagccaaagcggtcctgaatgatgaacgctacaaatcctttaaattgttcacctcagtgtttggcgttgggctgaagacagcagagaaatggttccgtatgggttttcgtaccctctcgaagattcagagcgataaaagccttcgcttcacgcaaatgcagaaagccggctttctgtattatgaagacctggtttcgtgcgttaaccgtccggaagcggaagctgtgtctatgctggtaaaagaggccgtcgtcacctttcttcctgatgcactggtgactatgacgggaggttttcgccgcggcaagatgaccgggcatgatgtggacttcctcattacatcaccggaagcgaccgaagatgaggagcaacagctgttgcacaaagttactgatttctggaaacagcagggtctgctgctgtactgtgacatcttggaaagcacgtttgagaaattcaaacaaccgtcccgtaaagtggatgcgcttgaccattttcagaaatgctttctgattctcaaactggatcatggccgcgttcactctgaaaaaagcggtcaacaagaaggaaagggctggaaagccatccgtgtcgatttggtgatgtgtccatatgatcgccgcgcattcgcgcttcttggttggaccggctcgcgtcagtttgaacgtgacctgcgtcgctacgctacccatgaacgcaagatgatgctggataatcacgccctgtatgaccgtacgaaacgcgtattcctcgaagcggagtcagaagaagaaatttttgcacatctggggctggattacattgaaccgtgggagcgtaacgct

SEQ ID NO: 3628 - protein, 390 aa, synthetic construct; identical to SEQ ID NO: 3620
  REGION 1..390: note = Orthologs of terminal deoxynucleotidyl transferase

SEQ ID NO: 3629 - DNA, 1197 bp, synthetic construct
  misc_feature 1..1197: note = Orthologs of terminal deoxynucleotidyl transferase
  source 1..1197: mol_type = other DNA
atgcaccatcatcatcatcatggcggtagcggcgatagtgcgaacccagatccgacagccggtaccctcaacattctgcctcctactacgaagaccatttctcagtatgcgtgtcaacgccgcaccaccatcaacaaccataatcagcgttttacggacgcattcgaaattcttgcgaagaattacgagttcaaagaaaacgatgatacttgcctgacctttatgcgtgctatttccgtgctgaaatgtcttccgtttgaggtagttagcctgaaagacacggaaggattgccctggatcggtgatgaagtcaaagggattatggaagaaatcatcgaggacggtgaatcgctggaagtgcaggccgtgctcaatgatgagcgctatcaaagcttcaaactgtttaccagtgtctttggagtggggctgaagacagcagacaaatggtaccgtatgggtttccgcacgctcaacaagattcgttccgataagaccctgaaattgaccaagatgcagaaagcgggtctgtgctattatgaagatcttattgattgtgtttcaaaagccgaagctgacgcggtatctctgctggttcaggatgcagtctggactttcttgccggatgcgctggtgactattacgggtggatttcgtcgtgggaaagagtttggtcacgacgttgatttccttatcacatctccgggagctgagaaagaacaagaagaccagctcctgcagaaagtgaccaatctgtggaagaaacaagggttgttgctgtactgcgatctgatcgaaagcacctttgaagatctgaaactcccatcccgcaagattgatgccctggaccatttccagaaatgctttctgatcctcaaactttatcaccataaagaggacaaacgcaaatgggaaatgccgacgggttcgaacgaaagcgaggccaaaagttggaaagcaattcgcgtagatctggttgtttgtccctacgatcgttatgcgtttgcgttgttgggttggagtggaagccgccaattcgaacgtgatctgcgccgctacgccacccacgagaagaagatgatgctggacaatcatgcgctgtatgacaagaccaagaaaatctttctcaaagctaaatcggaagaggaaattttcgcacatctggggcttgaatacattcagccgtccgaacgtaacgca

SEQ ID NO: 3630 - protein, 399 aa, synthetic construct
  REGION 1..399: note = Orthologs of terminal deoxynucleotidyl transferase
MHHHHHHGGSGDSANPDPTAGTLNILPPTTKTISQYACQRRTTINNHNQRFTDAFEILAKNYEFKENDDTCLTFMRAISVLKCLPFEVVSLKDTEGLPWIGDEVKGIMEEIIEDGESLEVQAVLNDERYQSFKLFTSVFGVGLKTADKWYRMGFRTLNKIRSDKTLKLTKMQKAGLCYYEDLIDCVSKAEADAVSLLVQDAVWTFLPDALVTITGGFRRGKEFGHDVDFLITSPGAEKEQEDQLLQKVTNLWKKQGLLLYCDLIESTFEDLKLPSRKIDALDHFQKCFLILKLYHHKEDKRKWEMPTGSNESEAKSWKAIRVDLVVCPYDRYAFALLGWSGSRQFERDLRRYATHEKKMMLDNHALYDKTKKIFLKAKSEEEIFAHLGLEYIQPSERNA

SEQ ID NO: 3631 - DNA, 1170 bp, synthetic construct
  misc_feature 1..1170: note = Orthologs of terminal deoxynucleotidyl transferase
  source 1..1170: mol_type = other DNA
atgcaccatcatcatcatcatggcggtagcggccagaatacacctaccgggaccgattgctcaccgccgactgccgttgcaaacgtgtcgcaatatgcttgtcagcgccgtacgacgaccgagaatcacaacaacaagatttttaccgatgtcatggaagaactggcggaatcttccgagttcaatgaaagcaaaggaccctgccttgcgtttcgtcaagccgcctccgtgctgaaaagcttaccgagtgcagttcactgtctgaaagctatccagggtttgccatgcctcggtgaacacacaaaagcagtgatggaggagattcttacctttgggcgcagcttcaaagtcgaagaaatccgctgtgacgaacgttaccaggccttgaaattatttacgtctgtgttcggtgtaggaccgaagaccgcagagaaatggtatcgccgtgggctccgctcgcttcaggaaattttgactgaacctaacatccaactcaatcgtatgcagcgtgccggttttctttactactcggatatttccaaagctgtcagcaaagccgaagcaaaagctgttgggtgcatcatcgaagataccttccattggattgcaccggacgccattttagccttaacgggtggttttcgtcgtggaaaagagtatgggcatgatgtggacttcttgttgactatgccggagatcggaaaagatgaaggtttacttcttcacgtgattgatcgtctcaaagaccagggtatcctcctctattgcgattatcaaggaagtacctttgacgtctcaaaattgccctcttgtcgcttcgaagatatggattgctttcagaagtgtttccttatcttacgcttggaacaaggtcaggttgaaggtgaacgtgggttacagcgcgatccaggagatagtcgtggttggcgtgctgtacgcgttgacttagtagcacctccggtcgatcgctacgcttttgcactcttggggtggactgggagccgttttggtcgtgatttgcgcaccttcgcccagaaagaacgccagatgctcctcgacaaccatgccctttatgacaagacaaagaaattgtgccttttagctacgacggaggaggacatttttacccatcttggtttggaatacgttgaaccgtggcaacgcaatgca

SEQ ID NO: 3632 - protein, 390 aa, synthetic construct
  REGION 1..390: note = Orthologs of terminal deoxynucleotidyl transferase
MHHHHHHGGSGQNTPTGTDCSPPTAVANVSQYACQRRTTTENHNNKIFTDVMEELAESSEFNESKGPCLAFRQAASVLKSLPSAVHCLKAIQGLPCLGEHTKAVMEEILTFGRSFKVEEIRCDERYQALKLFTSVFGVGPKTAEKWYRRGLRSLQEILTEPNIQLNRMQRAGFLYYSDISKAVSKAEAKAVGCIIEDTFHWIAPDAILALTGGFRRGKEYGHDVDFLLTMPEIGKDEGLLLHVIDRLKDQGILLYCDYQGSTFDVSKLPSCRFEDMDCFQKCFLILRLEQGQVEGERGLQRDPGDSRGWRAVRVDLVAPPVDRYAFALLGWTGSRFGRDLRTFAQKERQMLLDNHALYDKTKKLCLLATTEEDIFTHLGLEYVEPWQRNA

SEQ ID NO: 3633 - DNA, 1167 bp, synthetic construct
  misc_feature 1..1167: note = Orthologs of terminal deoxynucleotidyl transferase
  source 1..1167: mol_type = other DNA
atgcaccatcatcatcatcatggcggtagcggcagtgctaccccgaacccaggttttcagaaaaccccgccgctggcggtcaagaagattagccaatacgcatgccagcgcaagacgacgctgaacaactataatcacatcttcaccgatgcctttgaaattcttgcggagaattccgagttcaaagaaaacgaagtgagctacgtgacctttatgcgtgcggcgtccgttctgaaaagcctgccttttacgatcatctccatgaaagacactgaaggaattccgtgcctgggtgataaagtcaagtgtattattgaggaaatcatcgaagatggagaatcgtctgaggttaaagccgtgttgaatgacgaacgctatcagagcttcaaactctttacctcagtctttggtgtggggctgaagacaagcgagaaatggttccgtatggggtttcgctcgctttccaagattatgagcgataagacgctgaaattcaccaagatgcagaaagctggtttcttgtactacgaagatctggtatcttgcgttacccgtgccgaagcagaagcggtgggagtcctggtaaaagaagcagtctgggcttttttaccagacgcgtttgtgacaatgacgggtggttttcgtcgcgggaagaagattgggcacgatgtggacttccttatcacctctcctggaagtgcagaggatgaagaacaattactcccgaaagtcattaacctgtgggagaagaaaggtctgctgctgtattatgatttggtggaaagcactttcgagaaatttaaattaccgagtcgccaagttgacaccctcgatcatttccagaaatgttttctgatcctgaaattacatcaccagcgtgtagattcatcgaaatccaatcaacaggaaggtaagacgtggaaagcgattcgcgttgacttggtaatgtgcccctatgaaaaccgtgcctttgcattacttggatggaccgggagtcgccagttcgaacgtgatattcgtcgttacgcgactcatgagcgcaagatgatgctggacaatcacgccctgtatgataagacaaaacgcgtgtttctcaaagctgaaagcgaagaagagatctttgcgcatcttggtctggattacattgaaccatgggaacgcaacgca

SEQ ID NO: 3634 - protein, 389 aa, synthetic construct
  REGION 1..389: note = Orthologs of terminal deoxynucleotidyl transferase
MHHHHHHGGSGSATPNPGFQKTPPLAVKKISQYACQRKTTLNNYNHIFTDAFEILAENSEFKENEVSYVTFMRAASVLKSLPFTIISMKDTEGIPCLGDKVKCIIEEIIEDGESSEVKAVLNDERYQSFKLFTSVFGVGLKTSEKWFRMGFRSLSKIMSDKTLKFTKMQKAGFLYYEDLVSCVTRAEAEAVGVLVKEAVWAFLPDAFVTMTGGFRRGKKIGHDVDFLITSPGSAEDEEQLLPKVINLWEKKGLLLYYDLVESTFEKFKLPSRQVDTLDHFQKCFLILKLHHQRVDSSKSNQQEGKTWKAIRVDLVMCPYENRAFALLGWTGSRQFERDIRRYATHERKMMLDNHALYDKTKRVFLKAESEEEIFAHLGLDYIEPWERNA

SEQ ID NO: 3635 - DNA, 1161 bp, synthetic construct
  misc_feature 1..1161: note = Orthologs of terminal deoxynucleotidyl transferase
  source 1..1161: mol_type = other DNA
atgcaccatcatcatcatcatggcggtagcggcagccctagtccggtagttccgtctcgcgtgggtgtgtcgcaatatgcgtgtcagcgcaagacaacactggataacaagaataccttgttcactgacgcgtttgaaatcctggctgagaactatgaattccgtgaaaatgaacgttcctgcctcagctttcgtcaagccgcctcagtcctgaaaagccttacgtttaccattgctgggatggcggatgttgatggcttaccgggtttcggcgaccacattcgcgcagtgatcgaggatctgattgaagatggagaatcctccaaagtcagtgaggtactgaacgacgaagtgtatcgcagcctgaaattgtttaccaccatcttcggtgttggcttacgtactgctgagaaatggcatcgcctggggattcgtacgctcgaagaaatcaaaagtaatgaaaacctgaaattctcgaagatgcagattgcgggccttcagcactacgaggatatcttaggaggtgtgcgcaaagcagaagcggatgccgttgcgatggtcgtccgtgacgccgtgtggacgtttctgccagatgcagtagttaccctgaccggtggttttcgtcgcgggaacaaaacaggccatgacgtggatatgctcattactagccccattcagggcaaagagaaagaactgctgcacaaagtgatcaatctgtggaagaaacaagacttgcttttgtgtcatacgattcacgaatcaaccatggatgaagataacctgccgtcgaaaagcgttaatttactggaccattttcagaaatgcttcgcgatcctgaaatcaaaccaacatcgcggcgaaattagtagttgcgatggtcctcacgattcccgtgagcgcggcaaacgtatctggaaagccattcgcgtagacctcgtcttctgtccgtttgaacagtatgcttttgcgttgttaggatggaccggtagccgtcagtttgaacgcgatctgcgtcgttacgcaagccacgagaagaagatgatgatcgacaatcatgccctgtatgataagacgaaacgcgtgttcgtgaaatgcgaatccgaagaggagatttttggtcatctgggtctggaatacatcgatccggttgaacgtaacgct

SEQ ID NO: 3636 - protein, 387 aa, synthetic construct
  REGION 1..387: note = Orthologs of terminal deoxynucleotidyl transferase
MHHHHHHGGSGSPSPVVPSRVGVSQYACQRKTTLDNKNTLFTDAFEILAENYEFRENERSCLSFRQAASVLKSLTFTIAGMADVDGLPGFGDHIRAVIEDLIEDGESSKVSEVLNDEVYRSLKLFTTIFGVGLRTAEKWHRLGIRTLEEIKSNENLKFSKMQIAGLQHYEDILGGVRKAEADAVAMVVRDAVWTFLPDAVVTLTGGFRRGNKTGHDVDMLITSPIQGKEKELLHKVINLWKKQDLLLCHTIHESTMDEDNLPSKSVNLLDHFQKCFAILKSNQHRGEISSCDGPHDSRERGKRIWKAIRVDLVFCPFEQYAFALLGWTGSRQFERDLRRYASHEKKMMIDNHALYDKTKRVFVKCESEEEIFGHLGLEYIDPVERNA

SEQ ID NO: 3637 - DNA, 1173 bp, synthetic construct
  misc_feature 1..1173: note = Orthologs of terminal deoxynucleotidyl transferase
  source 1..1173: mol_type = other DNA
atgcaccatcatcatcatcatggcggtagcggctcacccgcctctccgaacccagatgcgcagaagactccgagtcgctccgtccagcgcattagcgagtatgcatgtcaacgtcgtaccaccctgaacaactgcaattacgccttcacaaatgcgtttgaaattctggctgaaaactgtgagttcaaagaaaatgaagacagctatgtgacgtacatccgcgcagcgtctgttctcaaaagcctgccgtttaccattatttccatgaaagatactgaaggtatcccttgcttaggcgatcgcgtgaaatgtatcatcgaggagattattgaagacggagaaagtagtgaagtaaatgccgtcctgaacgatgagcgctataaaagctttaagctgttcacgtccgtgtttggcgttggtctcaagacctcggagaaatggttccgtatggggtttcgtagcctgaacaagattaaatcagacaaaagcttgaaattcacacgcatgcagaaagcgggctttctttactacgaagatttagtgtcatgcgtaacccgtgcagaagccgaagctgtgtctacgctggtcaaagaagcggtttgggcgtttttacccggtgccttcatctctatgactggcggctttcgccgcgggaaagaaattggacacgatgtcgacttcctgatcaccagtccggaaattacggaggatgaagaacagcaggtgctgcataaagttatcaatttgtgggagaacaaaggtctgctgctgtatagcgatcttgtggaatcgacctttgagaaattgaagttaccatcccgtaaagttgacgcgctggatcactttcaaaaatgtttcctcattctgaaactgcatcatcaacgtgaagacaatgaaaagagctcacagcaggaagagaagacatggaaagcaatccgcgtcgatcttgtaatgtgcccgtatgaacgtcgtgcttttgccctgttaggttggaccggctcgcgccaattcgaacgcgatctgcgtcgttatgcaactcacgagcgcaagatgatgctcgataaccatgcgctgtacgacaagacgaaacgcatttttttgaaagccgaatccgaagaagaaattttcgcgcacctgggcctggattatatcgagccttgggaacgcaatgct

SEQ ID NO: 3638 - protein, 391 aa, synthetic construct
  REGION 1..391: note = Orthologs of terminal deoxynucleotidyl transferase
MHHHHHHGGSGSPASPNPDAQKTPSRSVQRISEYACQRRTTLNNCNYAFTNAFEILAENCEFKENEDSYVTYIRAASVLKSLPFTIISMKDTEGIPCLGDRVKCIIEEIIEDGESSEVNAVLNDERYKSFKLFTSVFGVGLKTSEKWFRMGFRSLNKIKSDKSLKFTRMQKAGFLYYEDLVSCVTRAEAEAVSTLVKEAVWAFLPGAFISMTGGFRRGKEIGHDVDFLITSPEITEDEEQQVLHKVINLWENKGLLLYSDLVESTFEKLKLPSRKVDALDHFQKCFLILKLHHQREDNEKSSQQEEKTWKAIRVDLVMCPYERRAFALLGWTGSRQFERDLRRYATHERKMMLDNHALYDKTKRIFLKAESEEEIFAHLGLDYIEPWERNA

SEQ ID NO: 3639 - DNA, 1143 bp, synthetic construct
  misc_feature 1..1143: note = Orthologs of terminal deoxynucleotidyl transferase
  source 1..1143: mol_type = other DNA
atgcaccatcatcatcatcatggcggtagcggcaatcctgccgccgaccagcgctcatgcgtgcatctttcggctactccggagtctgcggttagtccctatgcatgtcagcgtcgtaccaccttggaaaaccacaataagatttttacggaagcgctggaggtcctcgcgctgaactccgaatttagcggtaatcaaggttcatgcctgggttttcgccgcgctgccagcgtgttgaaatctttaccggcagcgctgcgttcgccagaagaagccctgcgcctcccgtgtctgggcgataactcgcgtgcggtcttggaggagatctgcgaatgtggtagctcaagtcgcgtggaagagattcagaatgatcaacgttaccgcaccatgaaacttttctgctctgtattcggcgttgggcctaagacagcagaaagctggttttgccgtggcctgaaaacgttcgaacaggtgttaactgaaccgtccatccgtctgaaccgcatgcagaccgccggttttctgttctatgaagacatttctgttcccgtatcacgcgcggaagctgccgcgctcaagatgatgatggaggaggcactgctgtttatcaatccgagtgcgacggtcaccattaccggcggctttcgtcgtgggaaagaattcggtcatgatgtggactttatcatcaaagccccagaaggacaagaagatcgcattcttccggctgtcattaaacgcttcaaaagccagaacgtgctgttgtactcggattttcagaaaagcacttttgacttacgtcaactgcctaaccatcgcttcgaggcgatggatcgctttagcaaatgtttcctgctggttaaattgcagatgcaggaaagtcgtacgggtcgtaattggcgcgcagtgcgtgttgatctcgtagcgccgccgcttgaacgcttcccatatgccttattaggctggacaggttcgaccctgtttgagcgtgacttgcgccgctttgctcgtctcgaacgtggcaagctgctggataaccacaccctgtacgacaaaacgacgaaaacctttcttccggcgaatactgaggaggatattttccaacatctggggctggaatatatcgaaccttggcagcgtaacgca

SEQ ID NO: 3640 - protein, 381 aa, synthetic construct
  REGION 1..381: note = Orthologs of terminal deoxynucleotidyl transferase
MHHHHHHGGSGNPAADQRSCVHLSATPESAVSPYACQRRTTLENHNKIFTEALEVLALNSEFSGNQGSCLGFRRAASVLKSLPAALRSPEEALRLPCLGDNSRAVLEEICECGSSSRVEEIQNDQRYRTMKLFCSVFGVGPKTAESWFCRGLKTFEQVLTEPSIRLNRMQTAGFLFYEDISVPVSRAEAAALKMMMEEALLFINPSATVTITGGFRRGKEFGHDVDFIIKAPEGQEDRILPAVIKRFKSQNVLLYSDFQKSTFDLRQLPNHRFEAMDRFSKCFLLVKLQMQESRTGRNWRAVRVDLVAPPLERFPYALLGWTGSTLFERDLRRFARLERGKLLDNHTLYDKTTKTFLPANTEEDIFQHLGLEYIEPWQRNA

SEQ ID NO: 3641 - DNA, 1182 bp, synthetic construct
  misc_feature 1..1182: note = Orthologs of terminal deoxynucleotidyl transferase
  source 1..1182: mol_type = other DNA
atgcaccatcatcatcatcatggcggtagcggcagcccaccgctgagcaccccggaactggagatgccagcgttcatcgccacgaaagtgagccagtacagttgccagcgcaaaaccacgctggacaattacaataaaaaatttaccgatgcgtttgaggtgatggccgagaactacgagttcaaagaaaatgagattttctgtctggaatttctgcgtgcggccagtctgctgaaaagtctgccattcagcgtgacccgcatgaaagacatccaaggcctcccatgcatgggtgaccaagttcgcgacattatcgaggagatcatcgaagaaggtgagagcagtcgtgtgaaggaagtgctgaatgacgagcgctataaggcgttcaagcaattcaccagcgttttcggtgtgggtgtgaagaccagtgaaaagtggtaccgcatgggcctccgcacggtggaagaagtgaaggcggacaaaacgctgaagctcagcaaaatgcagaaggccggcttcctctactatgaagacctcgtgagctgtgtgagcaaggccgaagcggatgcggttagcctcatcgtgaagaacacggtgtgtagctttctgccagatgcgctggtgaccatcaccggtggcttccgtcgcggcaaaaacatcggccacgacatcgacttcctcattaccaacccgggcccacgtgaggacgatgagctcctccacaaggtgatcgatctgtggaagaagcaaggtctgctgctgtactgcgacatcatcgagagcacgtttgtgaaggagcagctgccaagtcgcaaagttgacgccatggaccacttccagaagtgcttcgccattctcaagctgtaccagccacgcgtggataacagcacgtgcaacaccagcaagaagctcggtatggcggaagtgaaggattggaaggcgatccgcgttgatctggttatcaccccgttcgagcagtatgcgtacgcgctgctcggttggaccggtagccgtcagtttggtcgcgatctccgtcgctatgccgcgcacgagcgcaagatgattctggacaaccacgcgctgtatgaccgccgcaaacgcatctttctgaaaagcggcagcgaagaggagatctttgcgcatctgggtctggattacgttcagccgtgggaacgcaatgcc

SEQ ID NO: 3642 - protein, 394 aa, synthetic construct
  REGION 1..394: note = Orthologs of terminal deoxynucleotidyl transferase
MHHHHHHGGSGSPPLSTPELEMPAFIATKVSQYSCQRKTTLDNYNKKFTDAFEVMAENYEFKENEIFCLEFLRAASLLKSLPFSVTRMKDIQGLPCMGDQVRDIIEEIIEEGESSRVKEVLNDERYKAFKQFTSVFGVGVKTSEKWYRMGLRTVEEVKADKTLKLSKMQKAGFLYYEDLVSCVSKAEADAVSLIVKNTVCSFLPDALVTITGGFRRGKNIGHDIDFLITNPGPREDDELLHKVIDLWKKQGLLLYCDIIESTFVKEQLPSRKVDAMDHFQKCFAILKLYQPRVDNSTCNTSKKLGMAEVKDWKAIRVDLVITPFEQYAYALLGWTGSRQFGRDLRRYAAHERKMILDNHALYDRRKRIFLKSGSEEEIFAHLGLDYVQPWERNA

SEQ ID NO: 3643 - DNA, 1182 bp, synthetic construct
  misc_feature 1..1182: note = Orthologs of terminal deoxynucleotidyl transferase
  source 1..1182: mol_type = other DNA
atgcaccatcatcatcatcatggcggtagcggcagccatccgctgaacaccccggagctggaaatgccgagcttcatcgccaccaaggttagtcagtacagctgccaacgcaagacgacgctgaataactacaacaaaaagtttaccgacgcgtttgaagtgatggcggagaattacgaatttaaagagaacgagatcttctgcctcgagtttctgcgtgcggcgagtctgctgaaaagtctgccgttcagcgttacccgtatgaaagacatccaaggtctgccgtgcatgggtgatcaagttcgcgacgtgatcgaggagattatcgaagaaggcgaaagtagccgcgtgaaggaagtgctgaacgatgagcgctacaaagccttcaagcagttcacgagcgtgttcggcgttggcgtgaagaccagtgagaaatggtaccgcatgggcctccgcaccgttggcgaagtgaaagccgacaagacgctgaagctgagcaagatgcagaaggccggctttctgtactacgaggatctggtgagctgcgttagcaaagccgaagccgatgccgtgagcctcatcgtgaaaaacaccgtgtgcacgtttctgccagatgccctcgttaccattaccggtggttttcgccgcggcaagaatatcggccacgacatcgactttctcattaccaacccgggtccacgcgaggacgacgaactgctccacaaagtgatcgatctgtggaagaagcaaggtctgctgctgtactgcgacatcatcgagagcacgtttgtgaaggagcagctgccgagtcgcaaaatcgacgcgatggaccacttccagaaatgtttcgcgatcctcaagctgtaccaaccgcgcgttgataacagcacgtgcaacaccagcaagaagctcgagatggcggaagtgaaggattggaaagcgatccgtgtggatctggtgatcaccccgttcgaacagtacagctatgcgctgctgggctggacgggtagccgtcagttcggtcgcgatctgcgtcgctatgccgcgcatgaacgccgcatgattctggataaccatggtctgtacgaccgcaccaaacgcatctttctgaaagccggtagcgaagaagagatcttcgcgcatctgggtctggactatgtggaaccatgggaacgcaatgcc

SEQ ID NO: 3644 - protein, 394 aa, synthetic construct
  REGION 1..394: note = Orthologs of terminal deoxynucleotidyl transferase
MHHHHHHGGSGSHPLNTPELEMPSFIATKVSQYSCQRKTTLNNYNKKFTDAFEVMAENYEFKENEIFCLEFLRAASLLKSLPFSVTRMKDIQGLPCMGDQVRDVIEEIIEEGESSRVKEVLNDERYKAFKQFTSVFGVGVKTSEKWYRMGLRTVGEVKADKTLKLSKMQKAGFLYYEDLVSCVSKAEADAVSLIVKNTVCTFLPDALVTITGGFRRGKNIGHDIDFLITNPGPREDDELLHKVIDLWKKQGLLLYCDIIESTFVKEQLPSRKIDAMDHFQKCFAILKLYQPRVDNSTCNTSKKLEMAEVKDWKAIRVDLVITPFEQYSYALLGWTGSRQFGRDLRRYAAHERRMILDNHGLYDRTKRIFLKAGSEEEIFAHLGLDYVEPWERNA

SEQ ID NO: 3645 - DNA, 1182 bp, synthetic construct
  misc_feature 1..1182: note = Orthologs of terminal deoxynucleotidyl transferase
  source 1..1182: mol_type = other DNA
atgcaccatcatcatcatcatggcggtagcggctcaccaccattgaatacacctgtgcttgaaatgcccgcattcatcgcaactaaggtgtctcaatactcgtgccagcgtaagactacattaaataatagtaacaagaaattcaccgatgcatttgaagttatggcggagaactacgagttcaaagagaacgaaatcttctgcttagagttccttcgtgccgcctcgttgttaaaaagtcttccattctctgttactcgtatgaaagatatccaaggtcttccctgcatgggagatcaagtgcgtgacatcattgaggaaatcatcgaggaaggcgagtcctcccgcgtcaaagaggtattgaacgatgaacgctacaaggcttttaaacagtttacctccgtctttggcgtaggagtcaaaacgagtgagaagtggtatcgcatgggattacgcacagttggggaggtcaaggccgataaaaccctgaagttatcaaagatgcagaaggcggggttgctgtattatgaggatctggtctcttgcgtatctaaggcggaagctgatgctgtctcattaattgtcaaaaacaccgtctgcacattccttcctgacgccttagtaaccattacaggaggtttccgccgtggtaaaaatattggtcatgacatcgacttcttgattactaaccctgggcctcgtgaggatgacgagctgttacacaaagtaatcgacctgtggaagaagcaagggttgttattgtattgtgacattattgagtccacgtttgtaaaagaacagcttccctcgcgcaaggtggatgccatggatcacttccaaaagtgttttgcaattttgaaactttatcaacctcgcgtggataactcaacctgtaatactagcgaacaattggagatggccgaagtgaaagactggaaagcaattcgcgtagatttggttatcacccctttcgaacaatactcttacgctttgttaggttggacaggaagccgtcagtttggccgcgacctgcgccgctacgcagcccatgagcgtaaaatgatccttgacaatcatgggttgtacgatcgccgtaaacgtattttcttaaaagctggttcagaagaagaaattttcgcacacctgggtttagattacgtagaaccttgggagcgcaacgcg

SEQ ID NO: 3646 - protein, 394 aa, synthetic construct
  REGION 1..394: note = Orthologs of terminal deoxynucleotidyl transferase
MHHHHHHGGSGSPPLNTPVLEMPAFIATKVSQYSCQRKTTLNNSNKKFTDAFEVMAENYEFKENEIFCLEFLRAASLLKSLPFSVTRMKDIQGLPCMGDQVRDIIEEIIEEGESSRVKEVLNDERYKAFKQFTSVFGVGVKTSEKWYRMGLRTVGEVKADKTLKLSKMQKAGLLYYEDLVSCVSKAEADAVSLIVKNTVCTFLPDALVTITGGFRRGKNIGHDIDFLITNPGPREDDELLHKVIDLWKKQGLLLYCDIIESTFVKEQLPSRKVDAMDHFQKCFAILKLYQPRVDNSTCNTSEQLEMAEVKDWKAIRVDLVITPFEQYSYALLGWTGSRQFGRDLRRYAAHERKMILDNHGLYDRRKRIFLKAGSEEEIFAHLGLDYVEPWERNA

SEQ ID NO: 3647 - DNA, 10 bp, synthetic construct
  misc_feature 1..10: note = oligo substrate or (by)product
  source 1..10: mol_type = other DNA
tttttttatc

SEQ ID NO: 3648 - DNA, 11 bp, synthetic construct
  misc_feature 1..11: note = oligo substrate or (by)product
  misc_feature 11: note = MODIFIED_BASE - n is a 3'-NO2-thymine
  source 1..11: mol_type = other DNA
tttttttatcn

SEQ ID NO: 3649 - DNA, 11 bp, synthetic construct
  misc_feature 1..11: note = oligo substrate or (by)product
  source 1..11: mol_type = other DNA
tttttttatct

SEQ ID NO: 3650 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttatcn

SEQ ID NO: 3651 - DNA, 11 bp, synthetic construct
  misc_feature 1..11: note = oligo substrate or (by)product
  source 1..11: mol_type = other DNA
tttttttatcc

SEQ ID NO: 3652 - DNA, 11 bp, synthetic construct
  misc_feature 1..11: note = oligo substrate or (by)product
  misc_feature 11: note = MODIFIED_BASE - n is a 3'-PO4-thymine
  source 1..11: mol_type = other DNA
tttttttatcn

SEQ ID NO: 3653 - DNA, 10 bp, synthetic construct
  misc_feature 1..10: note = oligo substrate or (by)product
  source 1..10: mol_type = other DNA
tttttttatg

SEQ ID NO: 3654 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttatgn

SEQ ID NO: 3655 - DNA, 11 bp, synthetic construct
  misc_feature 1..11: note = oligo substrate or (by)product
  source 1..11: mol_type = other DNA
tttttttatgc

SEQ ID NO: 3656 - DNA, 11 bp, synthetic construct
  misc_feature 1..11: note = oligo substrate or (by)product
  misc_feature 11: note = MODIFIED_BASE - n is a 3'-PO4-guanine
  source 1..11: mol_type = other DNA
tttttttatcn

SEQ ID NO: 3657 - DNA, 11 bp, synthetic construct
  misc_feature 1..11: note = oligo substrate or (by)product
  source 1..11: mol_type = other DNA
tttttttatcg

SEQ ID NO: 3658 - DNA, 10 bp, synthetic construct
  misc_feature 1..10: note = oligo substrate or (by)product
  source 1..10: mol_type = other DNA
tttttttaca

SEQ ID NO: 3659 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttacan

SEQ ID NO: 3660 - DNA, 11 bp, synthetic construct
  misc_feature 1..11: note = oligo substrate or (by)product
  source 1..11: mol_type = other DNA
tttttttacac

SEQ ID NO: 3661 - DNA, 11 bp, synthetic construct
  misc_feature 1..11: note = oligo substrate or (by)product
  misc_feature 11: note = MODIFIED_BASE - n is a 3'-PO4-thymine
  source 1..11: mol_type = other DNA
tttttttatgn

SEQ ID NO: 3662 - DNA, 11 bp, synthetic construct
  misc_feature 1..11: note = oligo substrate or (by)product
  source 1..11: mol_type = other DNA
tttttttatgt

SEQ ID NO: 3663 - DNA, 11 bp, synthetic construct
  misc_feature 1..11: note = oligo substrate or (by)product
  misc_feature 11: note = MODIFIED_BASE - n is a 3'-PO4-guanine
  source 1..11: mol_type = other DNA
tttttttacan

SEQ ID NO: 3664 - DNA, 11 bp, synthetic construct
  misc_feature 1..11: note = oligo substrate or (by)product
  source 1..11: mol_type = other DNA
tttttttacag

SEQ ID NO: 3665 - DNA, 11 bp, synthetic construct
  misc_feature 1..11: note = oligo substrate or (by)product
  misc_feature 11: note = MODIFIED_BASE - n is a 3'-PO4-adenine
  source 1..11: mol_type = other DNA
tttttttatgn

SEQ ID NO: 3666 - DNA, 11 bp, synthetic construct
  misc_feature 1..11: note = oligo substrate or (by)product
  source 1..11: mol_type = other DNA
tttttttatga

SEQ ID NO: 3667 - DNA, 10 bp, synthetic construct
  misc_feature 1..10: note = oligo substrate or (by)product
  source 1..10: mol_type = other DNA
tttttttcgg

SEQ ID NO: 3668 - DNA, 11 bp, synthetic construct
  misc_feature 1..11: note = oligo substrate or (by)product
  misc_feature 11: note = MODIFIED_BASE - n is a 3'-PO4-guanine
  source 1..11: mol_type = other DNA
tttttttcggn

SEQ ID NO: 3669 - DNA, 11 bp, synthetic construct
  misc_feature 1..11: note = oligo substrate or (by)product
  source 1..11: mol_type = other DNA
tttttttcggg

SEQ ID NO: 3670 - DNA, 10 bp, synthetic construct
  misc_feature 1..10: note = oligo substrate or (by)product
  source 1..10: mol_type = other DNA
tttttttctg

SEQ ID NO: 3671 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttctgn

SEQ ID NO: 3672 - DNA, 11 bp, synthetic construct
  misc_feature 1..11: note = oligo substrate or (by)product
  source 1..11: mol_type = other DNA
tttttttctgc

SEQ ID NO: 3673 - DNA, 10 bp, synthetic construct
  misc_feature 1..10: note = oligo substrate or (by)product
  source 1..10: mol_type = other DNA
tttttttcga

SEQ ID NO: 3674 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttcgan

SEQ ID NO: 3675 - DNA, 11 bp, synthetic construct
  misc_feature 1..11: note = oligo substrate or (by)product
  source 1..11: mol_type = other DNA
tttttttcgac

SEQ ID NO: 3676 - DNA, 10 bp, synthetic construct
  misc_feature 1..10: note = oligo substrate or (by)product
  source 1..10: mol_type = other DNA
tttttttccg

SEQ ID NO: 3677 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttccgn

SEQ ID NO: 3678 - DNA, 11 bp, synthetic construct
  misc_feature 1..11: note = oligo substrate or (by)product
  source 1..11: mol_type = other DNA
tttttttccgc

SEQ ID NO: 3679 - DNA, 11 bp, synthetic construct
  misc_feature 1..11: note = oligo substrate or (by)product
  misc_feature 11: note = MODIFIED_BASE - n is a 3'-PO4-cytosine
  source 1..11: mol_type = other DNA
tttttttcggn

SEQ ID NO: 3680 - DNA, 11 bp, synthetic construct
  misc_feature 1..11: note = oligo substrate or (by)product
  source 1..11: mol_type = other DNA
tttttttcggc

SEQ ID NO: 3681 - DNA, 11 bp, synthetic construct
  misc_feature 1..11: note = oligo substrate or (by)product
  misc_feature 11: note = MODIFIED_BASE - n is a 3'-PO4-adenine
  source 1..11: mol_type = other DNA
tttttttacan

SEQ ID NO: 3682 - DNA, 11 bp, synthetic construct
  misc_feature 1..11: note = oligo substrate or (by)product
  source 1..11: mol_type = other DNA
tttttttacaa

SEQ ID NO: 3683 - DNA, 12 bp, synthetic construct
  misc_feature 1..12: note = oligo substrate or (by)product
  source 1..12: mol_type = other DNA
tttttttacaaa

SEQ ID NO: 3684 - DNA, 12 bp, synthetic construct
  misc_feature 1..12: note = oligo substrate or (by)product
  misc_feature 12: note = MODIFIED_BASE - n is a 3'-PO4-adenine
  source 1..12: mol_type = other DNA
tttttttacaan

SEQ ID NO: 3685 - DNA, 12 bp, synthetic construct
  misc_feature 1..12: note = oligo substrate or (by)product
  source 1..12: mol_type = other DNA
tttttttatccc

SEQ ID NO: 3686 - DNA, 12 bp, synthetic construct
  misc_feature 1..12: note = oligo substrate or (by)product
  misc_feature 12: note = MODIFIED_BASE - n is a 3'-PO4-cytosine
  source 1..12: mol_type = other DNA
tttttttatccn

SEQ ID NO: 3687 - DNA, 11 bp, synthetic construct
  misc_feature 1..11: note = oligo substrate or (by)product
  misc_feature 11: note = MODIFIED_BASE - n is a 3'-PO4-thymine
  source 1..11: mol_type = other DNA
tttttttacan

SEQ ID NO: 3688 - DNA, 12 bp, synthetic construct
  misc_feature 1..12: note = oligo substrate or (by)product
  misc_feature 12: note = MODIFIED_BASE - n is a 3'-PO4-thymine
  source 1..12: mol_type = other DNA
tttttttacaan

SEQ ID NO: 3689 - DNA, 11 bp, synthetic construct
  misc_feature 1..11: note = oligo substrate or (by)product
  misc_feature 11: note = MODIFIED_BASE - n is a 3'-PO4-adenine
  source 1..11: mol_type = other DNA
tttttttatcn

SEQ ID NO: 3690 - DNA, 12 bp, synthetic construct
  misc_feature 1..12: note = oligo substrate or (by)product
  misc_feature 12: note = MODIFIED_BASE - n is a 3'-PO4-adenine
  source 1..12: mol_type = other DNA
tttttttatccn

SEQ ID NO: 3691 - DNA, 12 bp, synthetic construct
  misc_feature 1..12: note = oligo substrate or (by)product
  misc_feature 12: note = MODIFIED_BASE - n is a 3'-PO4-thymine
  source 1..12: mol_type = other DNA
tttttttatccn

SEQ ID NO: 3692 - DNA, 12 bp, synthetic construct
  misc_feature 1..12: note = oligo substrate or (by)product
  source 1..12: mol_type = other DNA
tttttttcgggg

SEQ ID NO: 3693 - DNA, 12 bp, synthetic construct
  misc_feature 1..12: note = oligo substrate or (by)product
  misc_feature 12: note = MODIFIED_BASE - n is a 3'-PO4-guanine
  source 1..12: mol_type = other DNA
tttttttcgggn

SEQ ID NO: 3694 - DNA, 20 bp, synthetic construct
  misc_feature 1..20: note = oligo substrate or (by)product
  misc_feature 1: note = MODIFIED_BASE - n is a 6-carboxyfluorescein-thymine
  source 1..20: mol_type = other DNA
nttttttttttttttttatc

SEQ ID NO: 3695 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-guanine
  source 1..21: mol_type = other DNA
nttttttttttttttttatcn

SEQ ID NO: 3696 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-thymine
  source 1..21: mol_type = other DNA
nttttttttttttttttatcn

SEQ ID NO: 3697 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3698 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNHQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3699 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3700 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVMTPFEQFAYALLGWTGSGQFRRDLRRYAEEERDMLLDNHALYDLKKRIFLKAGSEEEIFAHLGLDYVEPWERNA

SEQ ID NO: 3701 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgagatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3702 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDEMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3703 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcggtcatctgggtctggattatgtggagccgtgggaacgcaacgcgtaa

SEQ ID NO: 3704 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFGHLGLDYVEPWERNA

SEQ ID NO: 3705 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgccaatttctgaaagcgggcagcgaagaagagattttcgcgcatctgggtctggattatgtggagccgtgggaacgcaacgcgtaa

SEQ ID NO: 3706 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRQFLKAGSEEEIFAHLGLDYVEPWERNA

SEQ ID NO: 3707 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgtgctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3708 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDVLLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3709 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcctgatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3710 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRLMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3711 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaagatgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3712 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKDDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3713 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtccgaaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3714 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSPKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3715 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcccgatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3716 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRPMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3717 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttatcccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3718 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFIPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3719 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaatgtgatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3720 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKCDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3721 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttggcccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3722 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFGPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3723 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgaatagcgaagaagagattttcgcgcatctgggtctggattatgtggagccgtgggaacgcaacgcgtaa

SEQ ID NO: 3724 - protein, 394 aa, synthetic construct; identical to SEQ ID NO: 3202
  REGION 1..394: note = Variant of terminal deoxynucleotidyl transferase

SEQ ID NO: 3725 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacggagccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3726 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITEPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3727 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgattgccgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3728 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDCRRYAEEERDMLLDNHALYDLKKRIFLKAGSEEEIFAHLGLDYVEPWERNA

SEQ ID NO: 3729 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcatgaccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3730 - protein, 394 aa, synthetic construct; identical to SEQ ID NO: 3204
  REGION 1..394: note = Variant of terminal deoxynucleotidyl transferase

SEQ ID NO: 3731 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcgtgcgaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3732 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYACEERDMLLDNHALYDLKKRIFLKAGSEEEIFAHLGLDYVEPWERNA

SEQ ID NO: 3733 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcagaaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3734 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKMDDELLHKVVDLLKKQGLLLYEDIKESTFVEGQLPSQKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3735 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcgctatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3736 - protein, 394 aa, synthetic construct; identical to SEQ ID NO: 3206
  REGION 1..394: note = Variant of terminal deoxynucleotidyl transferase

SEQ ID NO: 3737 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgccagatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3738 - protein, 394 aa, synthetic construct; identical to SEQ ID NO: 3208
  REGION 1..394: note = Variant of terminal deoxynucleotidyl transferase

SEQ ID NO: 3739 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaagttgatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3740 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNPGRKVDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3741 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcagtcatctgggtctggattatgtggagccgtgggaacgcaacgcgtaa

SEQ ID NO: 3742 - protein, 394 aa, synthetic construct; identical to SEQ ID NO: 3210
  REGION 1..394: note = Variant of terminal deoxynucleotidyl transferase

SEQ ID NO: 3743 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtacctttgtgccggatgcgctggtgaccatcgccggcggtttccgccgtggcaaacctatgggccacgacgttgactttctgatcacgaacattggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3744 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRTFVPDALVTIAGGFRRGKPMGHDVDFLITNIGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3745 - DNA, 1185 bp, synthetic construct
  misc_feature 1..1185: note = Variant of terminal deoxynucleotidyl transferase
  source 1..1185: mol_type = other DNA
atgcatcaccaccatcatcatgggggttctggtcatccgccgagcaataccccggagaaggaggtgccgagcgttatcgcccgtccggttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcatggttagtaaagaagaagccgatgccgttacgctcatcgtgaaggaaacggtgcgtgtgtttgtgccggatgcgctggtgaccatcgccggcggtttccgccgtggcaaacctatgggccacgacgttgactttctgatcacgaacccgggccgcaaaatggatgacgagctgctccacaaagtggttgatctgctcaagaagcaaggtctgctgctgtacgaagacatcaaagagagcacgttcgtggaggggcaactgccaagtcataaaatcgacgccatggacaacttccagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgccctctacgacctgaaaaagcgcatctttctgaaagcgggcagcgaagaagagattttcgcgcatctgggtctggattatgtggagccgtgggaacgcaacgcgtaa

SEQ ID NO: 3746 - protein, 394 aa, synthetic construct
  REGION 1..394: note = Variant of terminal deoxynucleotidyl transferase
MHHHHHHGGSGHPPSNTPEKEVPSVIARPVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASMVSKEEADAVTLIVKETVRVFVPDALVTIAGGFRRGKPMGHDVDFLITNPGRKMDDELLHKVVDLLKKQGLLLYEDIKESTFVEGQLPSHKIDAMDNFQKCFAILKLYQPKVDNSAVGTSKKSDMAEVKDWKAVRVDLVITPFEQFAYALLGWTGSGQFRRDLRRYAEEERDMLLDNHALYDLKKRIFLKAGSEEEIFAHLGLDYVEPWERNA

SEQ ID NO: 3747 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3748 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDLLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3749 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3750 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3751 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3752 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3753 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3754 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3755 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccatccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3756 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDFLITIPGRPEDDELLHKVVDLLKKQGLLLYEDIRESTFVEGQLPSPKIDALDNFQKCFAILKLYHPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3757 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttagtccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3758 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3759 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3760 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3761 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3762 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3763 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3764 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3765 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3766 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3767 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3768 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITNPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3769 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttagtccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3770 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDLLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3771 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3772 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3773 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3774 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDLLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3775 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3776 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3777 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3778 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3779 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3780 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVVPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3781 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3782 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3783 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3784 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDFLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3785 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3786 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3787 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3788 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3789 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3790 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3791 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3792 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3793 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3794 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDLLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3795 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3796 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVVPDALVTIAGGFRRGKPMGHDVDLLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3797 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3798 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3799 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggtcgtcctaccgatgacgaactgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3800 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3801 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3802 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3803 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3804 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3805 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3806 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3807 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgacttcctgatcacgaatccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3808 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3809 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3810 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3811 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3812 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3813 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3814 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3815 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3816 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDFLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3817 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3818 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3819 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgatccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3820 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPIRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3821 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgactttctgatcacgaatccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3822 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3823 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3824 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRPVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGQFLSAGSEEEIFGHLGLDYLEPWERNA

SEQ ID NO: 3825 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3826 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3827 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttgtaccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3828 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVVPDALVTIAGGFRRGKPMGHDVDLLITNPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3829 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3830 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDLLITNPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3831 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3832 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3833 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3834 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKPDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 3835 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3836 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPGRPEDDELLHKVVDLLKKQGLLLYEDIRESTFVEGQLPSPKPDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3837 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccatcgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3838 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3839 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttgtaccggatgcgctggtgaccatcgccggcggtttccgccgtggcaaacctatgggccacgacgttgactttctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3840 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3841 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3842 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITPPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3843 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3844 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3845 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3846 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITIPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3847 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3848 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKPDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3849 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgaaccgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3850 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPNRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3851 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgatccgtcctgaggatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3852 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPIRPEDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3853 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgatccgtcctgaggatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3854 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPIRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3855 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3856 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDLLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3857 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3858 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3859 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3860 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3861 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgggtcgtcctgaggatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcggatagcgaagaagagattttcggtcatctgggtctggattatctggagccgtgggaacgcaacgcg

SEQ ID NO: 3862 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSADSEEEIFGHLGLDYLEPWERNA

SEQ ID NO: 3863 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3864 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKQDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSADSEEEIFGHLGLDYLEPWERNA

SEQ ID NO: 3865 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacttcctgatcacgaatccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3866 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3867 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3868 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3869 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3870 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRPVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3871 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3872 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3873 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3874 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPGRPEDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3875 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3876 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3877 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttagtccggatgcgctggtgaccatcgccggcggtttccgccgtggcaaacctatgggccacgacgttgacctgctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3878 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDLLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3879 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3880 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKPDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3881 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggtcgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3882 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3883 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggtcgtcctgaggatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3884 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 3885 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3886 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRPVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3887 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttagtccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3888 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDFLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3889 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3890 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITPPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3891 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3892 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3893 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttgtaccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3894 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASVFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3895 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3896 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3897 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3898 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3899 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3900 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3901 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgaaccgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3902 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPNRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3903 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgatccgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3904 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPIRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3905 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3906 - protein, 394 aa, synthetic construct
  REGION 1..394: note = Variant of terminal deoxynucleotidyl transferase
MHHHHHHGGSGHPPGNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3907 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3908 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3909 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3910 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPGRPEDDELLHKVVDLLKKQGLLLYEDIRESTFVEGQLPSPKPDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSADSEEEIFGHLGLDYLEPWERNA

SEQ ID NO: 3911 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacttcctgatcacgaatccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3912 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3913 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggtcgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3914 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGQFLSAGSEEEIFGHLGLDYLEPWERNA

SEQ ID NO: 3915 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggtagcgaagaagagattttcggtcatctgggtctggattatctggagccgtgggaacgcaacgcg

SEQ ID NO: 3916 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3917 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3918 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 3919 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccctggccggcggtttccgccgtggcaaacctatgggccacgacgttgactttctgatcacgaacccgatccgtcctaccgatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcggatagcgaagaagagattttcggtcatctgggtctggattatctggagccgtgggaacgcaacgcg

SEQ ID NO: 3920 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTLAGGFRRGKPMGHDVDFLITNPIRPTDDELLHKVVDLLKKQGLLLYEDIRESTFVEGQLPSPKIDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGQFLSADSEEEIFGHLGLDYLEPWERNA

SEQ ID NO: 3921 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgaaccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3922 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPNRPTDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3923 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgaaccgtcctaccgatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgttgctcgacaaccatcgtctctacgacctgaaaaagggccagtttctgagtgcgggtagcgaagaagagattttcggtcatctgggtctggattatctggagccgtgggaacgcaacgcg

SEQ ID NO: 3924 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPNRPTDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 3925 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3926 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3927 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3928 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKPDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3929 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacctgctgatcacgaatccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3930 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDLLITNPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3931 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgacttcctgatcacgattccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3932 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITIPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3933 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtcctgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctggtcacgaacccgatccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggatagcgaagaagagattttcggtcatctgggtctggattatctggagccgtgggaacgcaacgcg

SEQ ID NO: 3934 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLVTNPIRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 3935 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgacttcctgatcacgccgccgggccgtcctgaagatgacgagctgctccacaaagtggttgatctgctcaagaagcaaggtctgctgctgtacgaaacgatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3936 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITPPGRPEDDELLHKVVDLLKKQGLLLYETIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3937 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcggaagtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcggatagcgaagaagagattttcggtcatctgggtctggattatctggagccgtgggaacgcaacgcg

SEQ ID NO: 3938 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDAEVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSADSEEEIFGHLGLDYLEPWERNA

SEQ ID NO: 3939 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttagtccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagatatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3940 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3941 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgctggttgtaccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatctttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3942 - protein, 394 aa, synthetic construct
  REGION 1..394: note = Variant of terminal deoxynucleotidyl transferase
MHHHHHHGGSGHPESNTPEKEVPSVIARHVSQYACQRKTTLNNYNKKFTDALEIMAENYKFKENLQACLEAKRAASILKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVALVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGIFRRDLRRYAEEERDMLLDNHRLYDLKKGIFLSAGSEEEIFGHLGLDYLEPWERNA

SEQ ID NO: 3943 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtctggttgtaccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3944 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3945 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3946 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3947 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatcttcaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgactgttgtaccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3948 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVVPDALVTIAGGFRRGKPMGHDVDFLITNPGRPEDDELLHKVVDLLKKQGLLLYEDIRESTFVEGQLPSPKIDALDNFQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3949 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgatccgtcctgaggatgacgagctgctccacaaagtggttgatctgctcaagaagcaaggtctgctgctgtacgaagacatccgtgagagcacgttcgtggaggggcaactgccaagtcctaaaccagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3950 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPIRPEDDELLHKVVDLLKKQGLLLYEDIRESTFVEGQLPSPKPDALDNFQKCFAILKLYQPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 3951 - DNA, 1182 bp, synthetic construct; identical to SEQ ID NO: 3835
  misc_feature 1..1182: note = Variant of terminal deoxynucleotidyl transferase
  source 1..1182: mol_type = other DNA

SEQ ID NO: 3952 - protein, 394 aa, synthetic construct; identical to SEQ ID NO: 3836
  REGION 1..394: note = Variant of terminal deoxynucleotidyl transferase

SEQ ID NO: 3953 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccctggccggcggtttccgccgtggcaaacctatgggccacgacgttgactttctgatcacgaacccgaaccgtcctgaggatgacgagctgctccacaaagtggttgatctgctcaagaagcaaggtctgctgctgtacgaagacatccgtgagagcacgttcgtggaggggcaactgccaagtcctaaacaagacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccagtttctgagtgcggatagcgaagaagagattttcggtcatctgggtctggattatctggagccgtgggaacgcaacgcg

SEQ ID NO: 3954 - protein, 394 aa, synthetic construct
  REGION 1..394: note = Variant of terminal deoxynucleotidyl transferase
MHHHHHHGGSGHPPSNTPEKEVPSVIARHVSPYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTLAGGFRRGKPMGHDVDFLITNPNRPEDDELLHKVVDLLKKQGLLLYEDIRESTFVEGQLPSPKQDALDNFQKCFAILKLYQPKVDNSAVGTSKKSDMAEVKDWKAVRVDLVITPFEQFAYALLGWTGSGQFRRDLRRYAEEERDMLLDNHRLYDLKKGQFLSADSEEEIFGHLGLDYLEPWERNA

SEQ ID NO: 3955 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccattgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3956 - protein, 394 aa, synthetic construct; identical to SEQ ID NO: 3926
  REGION 1..394: note = Variant of terminal deoxynucleotidyl transferase

SEQ ID NO: 3957 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3958 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3959 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtggttacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3960 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVVTPFEQFAYALLGWTGSGQFRRDLRRYAEEERDMLLDNHRLYDLKKGIFLSAGSEEEIFGHLGLDYLEPWERNA

SEQ ID NO: 3961 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctggttctggattatctggagccgtgggaacgcaacgcg

SEQ ID NO: 3962 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLVLDYLEPWERNA

SEQ ID NO: 3963 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaccggacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3964 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKPDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3965 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctgcatccgtgggaacgcaacgcg

SEQ ID NO: 3966 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLHPWERNA

SEQ ID NO: 3967 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggagtgggagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3968 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEWERDMLLDNHRLYDLKKGIFLSAGSEEEIFGHLGLDYLEPWERNA

SEQ ID NO: 3969 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgggggcgggcagcgaagaagagattttcggtcatctgggtctggattatctggagccgtgggaacgcaacgcg

SEQ ID NO: 3970 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLGAGSEEEIFGHLGLDYLEPWERNA

SEQ ID NO: 3971 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacaggctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3972 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDRLDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3973 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaggatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3974 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPRIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3975 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccaagggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3976 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPREQFAYALLGWTGSGQFRRDLRRYAEEERDMLLDNHRLYDLKKGIFLSAGSEEEIFGHLGLDYLEPWERNA

SEQ ID NO: 3977 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcacgcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3978 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFTQFAYALLGWTGSGQFRRDLRRYAEEERDMLLDNHRLYDLKKGIFLSAGSEEEIFGHLGLDYLEPWERNA

SEQ ID NO: 3979 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttctcgcatctgggtctggattatctggagccgtgggaacgcaacgcg

SEQ ID NO: 3980 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFSHLGLDYLEPWERNA

SEQ ID NO: 3981 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgtgtacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3982 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVCTPFEQFAYALLGWTGSGQFRRDLRRYAEEERDMLLDNHRLYDLKKGIFLSAGSEEEIFGHLGLDYLEPWERNA

SEQ ID NO: 3983 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattggctggagccgtgggaacgcaacgcg

SEQ ID NO: 3984 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDWLEPWERNA

SEQ ID NO: 3985 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcgctccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3986 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVIAPFEQFAYALLGWTGSGQFRRDLRRYAEEERDMLLDNHRLYDLKKGIFLSAGSEEEIFGHLGLDYLEPWERNA

SEQ ID NO: 3987 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcacgcatctgggtctggattatctggagccgtgggaacgcaacgcg

SEQ ID NO: 3988 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFTHLGLDYLEPWERNA

SEQ ID NO: 3989 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctttgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3990 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRFAEEERDMLLDNHRLYDLKKGIFLSAGSEEEIFGHLGLDYLEPWERNA

SEQ ID NO: 3991 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctgggcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3992 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRWAEEERDMLLDNHRLYDLKKGIFLSAGSEEEIFGHLGLDYLEPWERNA

SEQ ID NO: 3993 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctgacgatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3994 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALTIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 3995 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatcttttatagtgcgggcagcgaagaagagattttcggtcatctgggtctggattatctggagccgtgggaacgcaacgcg

SEQ ID NO: 3996 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFYSAGSEEEIFGHLGLDYLEPWERNA

SEQ ID NO: 3997 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgtctacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 3998 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVSTPFEQFAYALLGWTGSGQFRRDLRRYAEEERDMLLDNHRLYDLKKGIFLSAGSEEEIFGHLGLDYLEPWERNA

SEQ ID NO: 3999 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggagggggggctgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4000 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGGLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4001 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4002 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGMFRRDLRRYAEEERDMLLDNHRLYDLKKGIFLSAGSEEEIFGHLGLDYLEPWERNA

SEQ ID NO: 4003 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctggatctggattatctggagccgtgggaacgcaacgcg

SEQ ID NO: 4004 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLDLDYLEPWERNA

SEQ ID NO: 4005 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattccatcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4006 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFHQFAYALLGWTGSGQFRRDLRRYAEEERDMLLDNHRLYDLKKGIFLSAGSEEEIFGHLGLDYLEPWERNA

SEQ ID NO: 4007 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctggagctggattatctggagccgtgggaacgcaacgcg

SEQ ID NO: 4008 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLELDYLEPWERNA

SEQ ID NO: 4009 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgccgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4010 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMPLDNHRLYDLKKGIFLSAGSEEEIFGHLGLDYLEPWERNA

SEQ ID NO: 4011 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgaccagctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4012 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDQLDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4013 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccagaggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4014 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPEEQFAYALLGWTGSGQFRRDLRRYAEEERDMLLDNHRLYDLKKGIFLSAGSEEEIFGHLGLDYLEPWERNA

SEQ ID NO: 4015 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctgagtaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4016 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALSNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4017 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgcgcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4018 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFAQFAYALLGWTGSGQFRRDLRRYAEEERDMLLDNHRLYDLKKGIFLSAGSEEEIFGHLGLDYLEPWERNA

SEQ ID NO: 4019 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgaggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4020 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFEEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4021 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtgcctgggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4022 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVPGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4023 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4024 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPLEQFAYALLGWTGSGQFRRDLRRYAEEERDMLLDNHRLYDLKKGIFLSAGSEEEIFGHLGLDYLEPWERNA

SEQ ID NO: 4025 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagccggttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4026 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESRFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4027 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaagttgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4028 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKVDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4029 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccaccggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4030 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPPEQFAYALLGWTGSGQFRRDLRRYAEEERDMLLDNHRLYDLKKGIFLSAGSEEEIFGHLGLDYLEPWERNA

SEQ ID NO: 4031 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaaatcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4032 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPNPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4033 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttctcggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4034 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFSEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4035 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctggaggcgggcagcgaagaagagattttcggtcatctgggtctggattatctggagccgtgggaacgcaacgcg

SEQ ID NO: 4036 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLEAGSEEEIFGHLGLDYLEPWERNA

SEQ ID NO: 4037 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgggctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4038 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDGLDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4039 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtctgtatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4040 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRLYAEEERDMLLDNHRLYDLKKGIFLSAGSEEEIFGHLGLDYLEPWERNA

SEQ ID NO: 4041 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggatcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4042 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEDQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4043 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatagtctctacgacctgaaaaagggcatctttctgagtgcgggcagcgaagaagagattttcggtcatctgggtctggattatctggagccgtgggaacgcaacgcg

SEQ ID NO: 4044 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHSLYDLKKGIFLSAGSEEEIFGHLGLDYLEPWERNA

SEQ ID NO: 4045 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcaagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4046 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFKQFAYALLGWTGSGQFRRDLRRYAEEERDMLLDNHRLYDLKKGIFLSAGSEEEIFGHLGLDYLEPWERNA

SEQ ID NO: 4047 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccagcggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4048 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPAEQFAYALLGWTGSGQFRRDLRRYAEEERDMLLDNHRLYDLKKGIFLSAGSEEEIFGHLGLDYLEPWERNA

SEQ ID NO: 4049 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccataatctctacgacctgaaaaagggcatctttctgagtgcgggcagcgaagaagagattttcggtcatctgggtctggattatctggagccgtgggaacgcaacgcg

SEQ ID NO: 4050 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHNLYDLKKGIFLSAGSEEEIFGHLGLDYLEPWERNA

SEQ ID NO: 4051 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggagactcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4052 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVETQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4053 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagcggagattttcggtcatctgggtctggattatctggagccgtgggaacgcaacgcg

SEQ ID NO: 4054 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEAEIFGHLGLDYLEPWERNA

SEQ ID NO: 4055 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtgggaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4056 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSGKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4057 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacaagctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4058 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDKLDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4059 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgtgcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4060 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFVQFAYALLGWTGSGQFRRDLRRYAEEERDMLLDNHRLYDLKKGIFLSAGSEEEIFGHLGLDYLEPWERNA

SEQ ID NO: 4061 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggtcgctgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4062 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGSLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4063 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattccggcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4064 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFRQFAYALLGWTGSGQFRRDLRRYAEEERDMLLDNHRLYDLKKGIFLSAGSEEEIFGHLGLDYLEPWERNA

SEQ ID NO: 4065 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgacgctggattatctggagccgtgggaacgcaacgcg

SEQ ID NO: 4066 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLTLDYLEPWERNA

SEQ ID NO: 4067 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattccctcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4068 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFPQFAYALLGWTGSGQFRRDLRRYAEEERDMLLDNHRLYDLKKGIFLSAGSEEEIFGHLGLDYLEPWERNA

SEQ ID NO: 4069 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgggcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4070 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFGQFAYALLGWTGSGQFRRDLRRYAEEERDMLLDNHRLYDLKKGIFLSAGSEEEIFGHLGLDYLEPWERNA

SEQ ID NO: 4071 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtacgaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4072 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSTKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4073 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccagatgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4074 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPDEQFAYALLGWTGSGQFRRDLRRYAEEERDMLLDNHRLYDLKKGIFLSAGSEEEIFGHLGLDYLEPWERNA

SEQ ID NO: 4075 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcgttaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4076 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLIVNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4077 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcagtatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4078 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRQYAEEERDMLLDNHRLYDLKKGIFLSAGSEEEIFGHLGLDYLEPWERNA

SEQ ID NO: 4079 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacggtcatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4080 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDGHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4081 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggaccctcatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4082 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDPHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4083 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccagtggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4084 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPVEQFAYALLGWTGSGQFRRDLRRYAEEERDMLLDNHRLYDLKKGIFLSAGSEEEIFGHLGLDYLEPWERNA

SEQ ID NO: 4085 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccattctaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4086 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHSKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4087 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgactcgctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4088 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDSLDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4089 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatattgagccgtgggaacgcaacgcg

SEQ ID NO: 4090 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYIEPWERNA

SEQ ID NO: 4091 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaaacggagattttcggtcatctgggtctggattatctggagccgtgggaacgcaacgcg

SEQ ID NO: 4092 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSETEIFGHLGLDYLEPWERNA

SEQ ID NO: 4093 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaaacgatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4094 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKTMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4095 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaaagggagattttcggtcatctgggtctggattatctggagccgtgggaacgcaacgcg

SEQ ID NO: 4096 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEREIFGHLGLDYLEPWERNA

SEQ ID NO: 4097 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccggcggaacgcaacgcg

SEQ ID NO: 4098 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPAERNA

SEQ ID NO: 4099 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggagggggagctgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4100 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGELPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4101 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggtggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4102 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAVEERDMLLDNHRLYDLKKGIFLSAGSEEEIFGHLGLDYLEPWERNA

SEQ ID NO: 4103 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaggcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4104 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEARRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4105 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcgtcggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4106 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYASEERDMLLDNHRLYDLKKGIFLSAGSEEEIFGHLGLDYLEPWERNA

SEQ ID NO: 4107 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggctgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4108 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAAEERDMLLDNHRLYDLKKGIFLSAGSEEEIFGHLGLDYLEPWERNA

SEQ ID NO: 4109 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttccaggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4110 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFQEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4111 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatacgctctacgacctgaaaaagggcatctttctgagtgcgggcagcgaagaagagattttcggtcatctgggtctggattatctggagccgtgggaacgcaacgcg

SEQ ID NO: 4112 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHTLYDLKKGIFLSAGSEEEIFGHLGLDYLEPWERNA

SEQ ID NO: 4113 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggatgctgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4114 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGMLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4115 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtagttatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4116 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRSYAEEERDMLLDNHRLYDLKKGIFLSAGSEEEIFGHLGLDYLEPWERNA

SEQ ID NO: 4117 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatgggctctacgacctgaaaaagggcatctttctgagtgcgggcagcgaagaagagattttcggtcatctgggtctggattatctggagccgtgggaacgcaacgcg

SEQ ID NO: 4118 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHGLYDLKKGIFLSAGSEEEIFGHLGLDYLEPWERNA

SEQ ID NO: 4119 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccgccgagcaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtatttttaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtaccgttgtgccggatgcgctggtgaccatcgccggcggtttccgccgtggcaaacctatgggccacgacgttgactttctgatcacgaacccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccagccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagggcgggcagcgaagaagagattttcggtcatctgggtctggattatctggagccgtgggaacgcaacgcg

SEQ ID NO: 4120 - protein, 394 aa, synthetic construct
  REGION 1..394: note = Variant of terminal deoxynucleotidyl transferase
MHHHHHHGGSGHPPSNTPEKEVPSVIARHVSQYACQRKTTLNNYNKKFTDALEIMAENYKFKENLQACLEAKRAASIFKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVVPDALVTIAGGFRRGKPMGHDVDFLITNPGRPEDDELLHKVVDLLKKQGLLLYEDIRESTFVEGQLPSPKIDALDNHQKCFAILKLYQPKVDNSAVGTSKKSDMAEVKDWKAVRVDLVITPFEQFAYALLGWTGSGQFRRDLRRYAEEERDMLLDNHRLYDLKKGIFLRAGSEEEIFGHLGLDYLEPWERNA

SEQ ID NO: 4121 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtccggtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatacgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4122 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVMTPFEQFAYALLGWTGSGQFRRDTRRYAEEERDMLLDNHRLYDLKKGIFLSAGSEEEIFGHLGLDYLEPWERNA

SEQ ID NO: 4123 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4124 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4125 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcggaagaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4126 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTLAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSAGSEEEIFGHLGLDYLEPWERNA

SEQ ID NO: 4127 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaacttccagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4128 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNFQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4129 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaacttccagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4130 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKPDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4131 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4132 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4133 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctaccgttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4134 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPTDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4135 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4136 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 4137 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4138 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4139 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4140 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4141 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacctgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4142 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDLIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4143 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtccggtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcgagtgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4144 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTLAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDTRRYASEERDMLLDNHRLYDLKKGIFLSAGSEEEIFGHLGLDYLEPWERNA

SEQ ID NO: 4145 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccaggagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4146 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4147 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4148 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTLAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4149 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtggccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4150 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVARVSPDALVAIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4151 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacctgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4152 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDLIREIIEEGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4153 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4154 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4155 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaacttccagaagtgcttcgccattctcaagctgtaccgtccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatacgcgtcgctatgcgagtgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4156 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTLAGGFRRGKPMGHDVDLLITIPGRPEDDELLHKVVDLLKKQGLLLYEDIRESTFVEGQLPSPKPDALDNFQKCFAILKLYRPKVDNSAVGTSKKSDMAEVKDWKAVRVDLVMTPFEQFAYALLGWTGSGQFRRDTRRYASEERDMLLDNHRLYDLKKGIFLSAGSEEEIFGHLGLDYLEPWERNA

SEQ ID NO: 4157 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccaggagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcctggttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4158 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDLLITIPGRPTDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4159 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcctggttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4160 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4161 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4162 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4163 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4164 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4165 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctaccgttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4166 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPTDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4167 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacctgatccaggagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctctggttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4168 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDLIQEIIEVGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITIPGRPTDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4169 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctctggttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4170 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4171 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4172 - protein, 394 aa, synthetic construct; identical to SEQ ID NO: 4154
  REGION 1..394: note = Variant of terminal deoxynucleotidyl transferase

SEQ ID NO: 4173 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccaggagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4174 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIQEIIEEGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPTDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4175 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctctggttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4176 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4177 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcgagtgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4178 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYASEERDMLLDNHRLYDLKKGIFLSAGSEEEIFGHLGLDYLEPWERNA

SEQ ID NO: 4179 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcgagtgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4180 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYASEERDMLLDNHRLYDLKKGIFLSAGSEEEIFGHLGLDYLEPWERNA

SEQ ID NO: 4181 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcgagtgaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4182 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVITPFEQFAYALLGWTGSGQFRRDLRRYASEERDMLLDNHRLYDLKKGIFLSAGSEEEIFGHLGLDYLEPWERNA

SEQ ID NO: 4183 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4184 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4185 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccctggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcgagtgaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4186 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTLAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYASEERDMLLDNHRLYDLKKGIFLSADSEEEIFGHLGLDYLEPWERNA

SEQ ID NO: 4187 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4188 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4189 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcaccgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4190 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4191 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcctggttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4192 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRLVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4193 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacctgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctaccgatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4194 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDLIREIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4195 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacctgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctctggttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4196 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDLIREIIEVGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4197 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtccggtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaacttccagaagtgcttcgccattctcaagctgtaccgtccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatacgcgtcgctatgcggaagaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4198 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVMTPFEQFAYALLGWTGSGQFRRDTRRYAEEERDMLLDNHRLYDLKKGIFLSAGSEEEIFGHLGLDYLEPWERNA

SEQ ID NO: 4199 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctaccgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4200 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4201 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4202 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4203 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctaccgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4204 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4205 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatgacgccattcgagcagttcgcctatgcgctgctcggttggacgggcagcggccaatttcgtcgcgatctgcgtcgctatgcggaagaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4206 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVMTPFEQFAYALLGWTGSGQFRRDLRRYAEEERDMLLDNHRLYDLKKGIFLSAGSEEEIFGHLGLDYLEPWERNA

SEQ ID NO: 4207 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctcgcgttagtccggatgcgctggtgaccatcgccggcggtttccgccgtggcaaacctatgggccacgacgttgacctgctgatcacgattccgggccgtcctgaggatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4208 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4209 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatacgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4210 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKIDALDNFQKCFAILKLYRPKVDNSAVGTSKKSDMAEVKDWKAVRVDLVITPFEQFAYALLGWTGSGQFRRDTRRYAEEERDMLLDNHRLYDLKKGIFLSAGSEEEIFGHLGLDYLEPWERNA

SEQ ID NO: 4211 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatccgtgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctctggttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaaattccaagtcctaaaatcgacgccctggacaactttcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggccaatttctgagtgcgggcagcgaagaagagattttcggtcatctgggtctggattatctggagccgtgggaacgcaacgcg

SEQ ID NO: 4212 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVALVSPDALVTIAGGFRRGKPMGHDVDLLITIPGRPEDDELLHKVVDLLKKQGLLLYEDIRESTFVEGQIPSPKIDALDNFQKCFAILKLYRPKVDNSAVGTSKKSDMAEVKDWKAVRVDLVITPFEQFAYALLGWTGSGQFRRDLRRYAEEERDMLLDNHRLYDLKKGQFLSAGSEEEIFGHLGLDYLEPWERNA

SEQ ID NO: 4213 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcggaggtgaccattgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaaattgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcgggcagcgaagaagagattttcggtcatctgggtctggattatctggagccgtgggaacgcaacgcg

SEQ ID NO: 4214 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDAEVTIAGGFRRGKPMGHDVDLLITIPGRPEDDELLHKVVDLLKKQGLLLYEDIRESTFVEGQLPSPKIDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSAGSEEEIFGHLGLDYLEPWERNA

SEQ ID NO: 4215 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4216 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4217 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4218 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDYLEPWERNA

SEQ ID NO: 4219 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4220 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDYLEPWERNA

SEQ ID NO: 4221 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggttgcgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4222 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVVAPFEQFAYALLGWTGSGQFRRDLRRYAEEERDMLLDNHRLYDLKKGIFLSADSEEEIFGHLDLDYLEPWERNA

SEQ ID NO: 4223 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4224 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDWLEPWERNA

SEQ ID NO: 4225 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4226 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4227 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4228 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDYLEPWERNA

SEQ ID NO: 4229 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4230 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDYLEPWERNA

SEQ ID NO: 4231 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4232 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4233 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4234 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDWLEPWERNA

SEQ ID NO: 4235 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4236 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4237 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4238 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDWLEPWERNA

SEQ ID NO: 4239 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4240 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4241 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4242 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4243 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4244 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4245 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4246 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGRPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDWLEPWERNA

SEQ ID NO: 4247 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtggtaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcatgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4248 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSGKPDALDNHQKCFAILKLYRPKVDNSAVGTSKKSDMAEVKDWKAVRVDLVITPFEQFAYALLGWTGSGMFRRDLRRYAEEERDMLLDNHRLYDLKKGIFLSADSEEEIFGHLGLDYLEPWERNA

SEQ ID NO: 4249 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4250 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4251 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4252 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDWLEPWERNA

SEQ ID NO: 4253 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4254 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4255 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4256 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDWLEPWERNA

SEQ ID NO: 4257 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4258 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4259 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4260 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDLRRYAEEERDMLLDNHRLYDLKKGIFLSADSEEEIFGHLDLDYLEPWERNA

SEQ ID NO: 4261 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4262 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDWLEPWERNA

SEQ ID NO: 4263 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4264 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4265 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4266 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4267 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4268 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4269 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4270 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4271 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4272 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDWLEPWERNA

SEQ ID NO: 4273 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgtcgcgagtgtcctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctgggcctggattatctggagccgtgggaacgcaacgcg

SEQ ID NO: 4274 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRVASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4275 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgatgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccacgtgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggaaccgtgggaacgcaacgcg

SEQ ID NO: 4276 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPREQFAYALLGWTGSGQFRRDLRRYAEEERDMLLDNHRLYDLKKGIFLSADSEEEIFGHLGLDYLEPWERNA

SEQ ID NO: 4277 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4278 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4279 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4280 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDWLEPWERNA

SEQ ID NO: 4281 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcactattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattccaccagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcgggcatctgggtctggattatctggagccgtgggaacgcaacgcg

SEQ ID NO: 4282 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFHQFAYALLGWTGSGQFRRDLRRYAEEERDMLLDNHRLYDLKKGIFLSADSEEEIFGHLGLDYLEPWERNA

SEQ ID NO: 4283 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4284 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4285 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4286 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLDLDYLEPWERNA

SEQ ID NO: 4287 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4288 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDWLEPWERNA

SEQ ID NO: 4289 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4290 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4291 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4292 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGRPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDYLEPWERNA

SEQ ID NO: 4293 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4294 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDWLEPWERNA

SEQ ID NO: 4295 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4296 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4297 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtccggtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccagaggagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggaaccgtgggaacgcaacgcg

SEQ ID NO: 4298 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPEEQFAYALLGWTGSGQFRRDLRRYAEEERDMLLDNHRLYDLKKGIFLSADSEEEIFGHLGLDYLEPWERNA

SEQ ID NO: 4299 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4300 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPRPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDYLEPWERNA

SEQ ID NO: 4301 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4302 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGKPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDYLEPWERNA

SEQ ID NO: 4303 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4304 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4305 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4306 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDYLEPWERNA

SEQ ID NO: 4307 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatcttttatagtgcggacagcgaagaagagattttcggtcatctgggtctggattatctggagccgtgggaacgcaacgcg

SEQ ID NO: 4308 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFYSADSEEEIFGHLGLDYLEPWERNA

SEQ ID NO: 4309 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatcttttatagtgcggacagcgaagaagagattttcggtcatctgggtctggattatctggagccgtgggaacgcaacgcg

SEQ ID NO: 4310 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFYSADSEEEIFGHLGLDYLEPWERNA

SEQ ID NO: 4311 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggcctggattatctggagccgtgggaacgcaacgcg

SEQ ID NO: 4312 - protein, 394 aa, synthetic construct; identical to SEQ ID NO: 4240
  REGION 1..394: note = Variant of terminal deoxynucleotidyl transferase

SEQ ID NO: 4313 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggttacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4314 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVVTPFEQFAYALLGWTGSGQFRRDLRRYAEEERDMLLDNHRLYDLKKGIFLSADSEEEIFGHLGLDYLEPWERNA

SEQ ID NO: 4315 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggctactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4316 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4317 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4318 - protein, 394 aa, synthetic construct; identical to SEQ ID NO: 4272
  REGION 1..394: note = Variant of terminal deoxynucleotidyl transferase

SEQ ID NO: 4319 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagccgtttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcgggcatctgggtctggattatctggagccgtgggaacgcaacgcg

SEQ ID NO: 4320 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESRFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4321 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4322 - protein, 394 aa, synthetic construct; identical to SEQ ID NO: 4258
  REGION 1..394: note = Variant of terminal deoxynucleotidyl transferase

SEQ ID NO: 4323 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggttgcgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggcctggattatctggagccgtgggaacgcaacgcg

SEQ ID NO: 4324 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVVAPFEQFAYALLGWTGSGQFRRDLRRYAEEERDMLLDNHRLYDLKKGIFLSADSEEEIFGHLGLDYLEPWERNA

SEQ ID NO: 4325 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcactattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggaccgtcatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4326 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDRHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4327 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcactattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcgaacgaagagcgcgacatgctgctcgacaaccatcgtctctacgacctgaaaaagggcatctttctgagtgcggacagcgaagaagagattttcgggcatctgggtctggattatctggagccgtgggaacgcaacgcg

SEQ ID NO: 4328 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYANEERDMLLDNHRLYDLKKGIFLSADSEEEIFGHLGLDYLEPWERNA

SEQ ID NO: 4329 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4330 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDWLEPWERNA

SEQ ID NO: 4331 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagtgggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtcctaagcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcacgtttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattggctggagccgtgggaacgcaacgcg

SEQ ID NO: 4332 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGTFRRDLRRYAEEERDMLLDNHRLYDLKKGIFLSADSEEEIFGHLGLDWLEPWERNA

SEQ ID NO: 4333 - DNA, 1182 bp, synthetic construct; identical to SEQ ID NO: 4263
  misc_feature 1..1182: note = Variant of terminal deoxynucleotidyl transferase
  source 1..1182: mol_type = other DNA

SEQ ID NO: 4334 - protein, 394 aa, synthetic construct; identical to SEQ ID NO: 4264
  REGION 1..394: note = Variant of terminal deoxynucleotidyl transferase

SEQ ID NO: 4335 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctactgatgacgagctgctccacaaagtggttgatctgctcaagaagcaaggtctgctgctgtacgaagacatccgtgagagcacgttcgtggaggggcaactgccaagtggtcgtcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4336 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPSGRPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4337 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggcaactttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4338 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGNFRRDLRRYAEEERDMLLDNHRLYDLKKGIFLSADSEEEIFGHLGLDYLEPWERNA

SEQ ID NO: 4339 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggttgcgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4340 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVVAPFEQFAYALLGWTGSGQFRRDLRRYAEEERDMLLDNHRLYDLKKGIFLSADSEEEIFGHLGLDYLEPWERNA

SEQ ID NO: 4341 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagccgtttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattccaccagttcgcctatgcgctgctcggttggacgggcagcggccaatttcgtcgcgatctgcgtcgctatgcgaacgaagagcgcgacatgctgctcgacaaccatcgtctctacgacctgaaaaagggcatctttctgagtgcggacagcgaagaagagattttcgggcatctgggtctggattatctggagccgtgggaacgcaacgcg

SEQ ID NO: 4342 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESRFVEGQLPSPKPDALDNHQKCFAILKLYRPKVDNSAVGTSKKSDMAEVKDWKAVRVDLVITPFHQFAYALLGWTGSGQFRRDLRRYANEERDMLLDNHRLYDLKKGIFLSADSEEEIFGHLGLDYLEPWERNA

SEQ ID NO: 4343 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcgttattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattccaccagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4344 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLIVIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFHQFAYALLGWTGSGQFRRDLRRYAEEERDMLLDNHRLYDLKKGIFLSADSEEEIFGHLGLDYLEPWERNA

SEQ ID NO: 4345 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgggcctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4346 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAGLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLGLDYLEPWERNA

SEQ ID NO: 4347 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcgttattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4348 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLIVIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4349 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatcctgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4350 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDPELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4351 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtttatgaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4352 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVYEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4353 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaatgggacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4354 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKWDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4355 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgaagatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4356 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTKIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4357 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgatgctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4358 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLMLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4359 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttacggcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4360 - protein, 394 aa, synthetic construct
  REGION 1..394: note = Variant of terminal deoxynucleotidyl transferase
MHHHHHHGGSGHPEGNTPEKEVPSVTARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4361 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctggatcgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4362 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLDRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4363 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacggatatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4364 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTDIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4365 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagccgctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4366 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKPLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4367 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtttgaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4368 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSLKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4369 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtaatagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4370 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRNSTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4371 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctcccgaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4372 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLPKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4373 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgatgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggatgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4374 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGMSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4375 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatctctgagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4376 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIISEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4377 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggatttgagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4378 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDLSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4379 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaaggggagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4380 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKGSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4381 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagtgtaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4382 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAECKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4383 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggcctagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4384 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGPSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4385 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagtatagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4386 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKYSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4387 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagcagaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4388 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEQKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4389 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4390 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4391 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaagtggacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4392 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKVDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4393 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatagtgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggtcgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4394 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDSELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4395 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaagaggagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4396 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKRSKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4397 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatgtcggaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4398 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMSEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4399 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgggtatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4400 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTGIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4401 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagtatctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4402 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKEYLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4403 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagcggatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4404 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALERMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4405 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggataaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4406 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEDKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4407 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttgctgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4408 - protein, 394 aa, synthetic construct
  REGION 1..394: note = Variant of terminal deoxynucleotidyl transferase
MHHHHHHGGSGHPEGNTPEKEVPSVAARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4409 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctttggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4410 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMALVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4411 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaaggggctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4412 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKGLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4413 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtgtgtgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4414 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVCDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4415 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagggcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4416 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNRAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4417 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgactgacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4418 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMTDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4419 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgactgtgctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4420 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDCAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4421 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcgattaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4422 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSIKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4423 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgactccctggacaaccatcagaagtgcttcgccattctcaagctgtaccgtaataaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4424 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDSLDNHQKCFAILKLYRNKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4425 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaagtggagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4426 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKWSKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4427 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgtgtctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4428 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLCLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4429 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacggctatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4430 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTAIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4431 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagaataaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4432 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAENKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4433 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggtctagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4434 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGSSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4435 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgtgtatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4436 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTCIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4437 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggttaacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4438 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVVNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4439 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaagggggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4440 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKGDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4441 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttggggttagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4442 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGVSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4443 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctattgttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4444 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAIVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4445 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtgattgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4446 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVIDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4447 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagactgtcgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4448 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDCRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4449 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggcgaacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4450 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVANSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4451 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagtataaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4452 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEYKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4453 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgaggattacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4454 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAEDYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4455 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactgcaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacggatatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4456 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNCNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTDIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4457 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaagactgataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4458 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKTDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4459 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgcttggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4460 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLALGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4461 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttccgttattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4462 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFRYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4463 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagattgtgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4464 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDCELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4465 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgatggacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4466 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMMDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4467 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttacgaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4468 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVTKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4469 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaatctaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4470 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKSNLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4471 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgctggaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4472 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTLEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4473 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagttctatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4474 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSSMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4475 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtgaagaacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4476 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVKNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4477 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagacgaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4478 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAETKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4479 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacactgctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4480 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDTAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4481 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtccgagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4482 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASPSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4483 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattacccaggacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4484 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITQDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4485 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaaccttatggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4486 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPYGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4487 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacgttcgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4488 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDVRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4489 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagaggggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4490 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKRGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4491 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcctggtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4492 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLLVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4493 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtggtaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4494 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSGKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4495 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtagtctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4496 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGSLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4497 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttcaggcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4498 - protein, 394 aa, synthetic construct
  REGION 1..394: note = Variant of terminal deoxynucleotidyl transferase
MHHHHHHGGSGHPEGNTPEKEVPSVQARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4499 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccggtgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4500 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITGDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4501 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatattgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4502 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADIVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4503 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaaggctctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4504 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKALKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4505 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagctgttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4506 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKAVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4507 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctagggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4508 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMARVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4509 - DNA, 1182 bp, synthetic construct
  misc_feature 1..1182: note = Variant of terminal deoxynucleotidyl transferase
  source 1..1182: mol_type = other DNA
atgcatcaccaccatcatcatggggattctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagttctaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4510 - protein, 394 aa, synthetic construct
  REGION 1..394: note = Variant of terminal deoxynucleotidyl transferase
MHHHHHHGDSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSSKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4511 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaatagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4512 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKNSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4513 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagcccgggccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4514 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEARAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4515 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttggggagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4516 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFGENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4517 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaacttttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4518 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKLFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4519 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtaataaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4520 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRNKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4521 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcatggagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4522 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIMEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4523 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggcggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4524 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKADNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4525 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggcttttgttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4526 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAFVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4527 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagtcttacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4528 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAESYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4529 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtgtgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4530 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSVKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4531 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatatgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4532 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDMLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4533 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagattctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4534 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKILKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4535 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcaatgagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4536 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIINEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4537 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatattctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4538 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDILKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4539 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaagattgataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4540 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKIDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4541 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatgcgggaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4542 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMREVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4543 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctccgtaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4544 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLRKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4545 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggattctagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4546 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDSSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4547 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgtggagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4548 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIVEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4549 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctgagtgccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4550 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLSAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4551 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaagagtgataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4552 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKSDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4553 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgacgaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4554 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTTKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4555 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagtttgcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4556 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQFAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4557 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccggtgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4558 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEAGAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4559 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaatcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4560 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKNQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4561 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagattatgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4562 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDYELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4563 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctagtggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4564 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPSGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4565 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttggtctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4566 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVGLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4567 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggaggaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4568 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMEEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4569 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtcgtaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4570 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRRKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4571 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtccgatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4572 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSPMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4573 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgttgtgttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4574 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRCVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4575 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagcgtaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4576 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAERKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4577 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgtttttgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4578 - protein, 394 aa, synthetic construct
  REGION 1..394: note = Variant of terminal deoxynucleotidyl transferase
MHHHHHHGGSGHPEGNTPEKEVPSVFARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4579 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtactatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4580 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSTMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4581 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttgcggagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4582 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFAENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4583 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagcttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4584 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAELKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4585 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatacggagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4586 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDTELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4587 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagttgtaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4588 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSCKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4589 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgttatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4590 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSVMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4591 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgactcgctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4592 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDSLLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4593 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccaatgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4594 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITNDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4595 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggaggtgatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4596 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEVMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4597 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttctgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4598 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVLLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4599 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacggggaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4600 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTGKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4601 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagcagagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4602 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKQSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4603 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggcttctgttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4604 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMASVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4605 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtatggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4606 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRMVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4607 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgttgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4608 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITVDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4609 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgtatatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4610 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTYIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4611 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcagtattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4612 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFSILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4613 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggatcctagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4614 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDPSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4615 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtggcggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4616 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVAETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4617 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtgcgaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4618 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSAKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4619 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4620 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTAEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4621 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacggcgaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4622 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTAKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4623 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagactctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4624 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKTLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4625 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtgtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4626 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKCLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4627 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttttgaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4628 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVLKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4629 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgatgcgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4630 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLMRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4631 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttgatctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4632 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVDLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4633 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggcgaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4634 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEAKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4635 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcttggagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4636 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIILEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4637 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacggtgaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4638 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTVKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4639 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggtttagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4640 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGFSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4641 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgttataaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4642 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRYKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4643 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagtctcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4644 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKSQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4645 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttcagaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4646 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVQKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4647 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttagggagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4648 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFRENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4649 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaattttgggagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4650 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFWENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4651 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaggggacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4652 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKGDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4653 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacgcggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4654 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDAAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4655 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgatgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4656 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLMLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4657 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatctatgagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4658 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIYEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4659 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatccgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4660 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDPLVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4661 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacggggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4662 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDGAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4663 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgagtttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4664 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEFKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4665 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggtttgtctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4666 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVCLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4667 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctctgtgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4668 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLCVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4669 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcacggagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4670 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIITEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4671 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatggtgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4672 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADGVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4673 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggctgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4674 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPAALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4675 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtacatgatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4676 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYMMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4677 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagcctagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4678 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKPSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4679 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacccggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4680 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDPAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4681 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaactggacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4682 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKLDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4683 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcatgctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4684 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGMLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4685 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagttgcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4686 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKLQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4687 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtattaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4688 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSIKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4689 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaaggtgctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4690 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKVLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4691 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagatgagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4692 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKMSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4693 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacttgcaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4694 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDLQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4695 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgggatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4696 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSGMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4697 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttggggcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4698 - protein, 394 aa, synthetic construct
  REGION 1..394: note = Variant of terminal deoxynucleotidyl transferase
MHHHHHHGGSGHPEGNTPEKEVPSVGARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4699 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggtttctctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4700 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVSLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4701 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacggttatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4702 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTVIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4703 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacctggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4704 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDLAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4705 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctggttcgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4706 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLVRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4707 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgactgggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4708 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDWAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4709 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgattgtgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4710 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADCVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4711 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatttggagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4712 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDLELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4713 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaaggctagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4714 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKASDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4715 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagcggagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4716 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKRSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4717 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaggctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4718 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILRLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4719 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcgtggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4720 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIVAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4721 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataactgtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4722 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNCAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4723 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaaggggcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4724 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKGQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4725 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggaggcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4726 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPEALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4727 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgaatcgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4728 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPNRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4729 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccatttgtaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4730 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAICKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4731 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaagcgcgccgcgagtgtcctgaaaagcctgccgttcgaggttaccagcatgaaagacatccaaggtctgccgtgcattaccgacgacgtacgtgacgtgatcgaggagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcgagtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaagtcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcacgccattcgagcagttcgcctatgcgctgctcggttggacgggcagcggccaatttcgtcgcgatctgcgtcgctatgcggaggaagagcgcgacatgctgctcgacaaccatcgtctctacgacctgaaaaagggcatctttctgagtgcggacagcgaagaagagattttcggtcatctgggtctggattatctggagccgtgggaacgcaacgcg

SEQ ID NO: 4732 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFEYYEDLASGVSKEEADAVTLIVKETVRTVSPDALVTIAGGFRRGKPMGHDVDLLITIPGRPEDDELLHKVVDLLKKQGLLLYEDIRESTFVEGQLPSPKPDALDNHQKCFAILKLYRPKVDNSAVGTSKKSDMAEVKDWKAVRVDLVITPFEQFAYALLGWTGSGQFRRDLRRYAEEERDMLLDNHRLYDLKKGIFLSADSEEEIFGHLGLDYLEPWERNA

SEQ ID NO: 4733 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4734 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 4735 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaaacgcgtggcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcaactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggcatgtttcgtcgcgatacgcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4736 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRVASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGMFRRDTRRYAEEERDMLLDNHRLYDLKKGIFLSADSEEEIFGHLDLDYLEPWERNA

SEQ ID NO: 4737 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4738 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4739 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 4740 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 4741 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4742 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4743 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4744 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4745 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaaacgcgcggcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggatgctgccaagtcctaaacctgacaaactggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggcatgtttcgtcgcgatacgcgtcgctttgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4746 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGMLPSPKPDKLDNHQKCFAILKLYRPKVDNSAVGTSKKSDMAEVKDWKAVRVDLVIAPFEQFAYALLGWTGSGMFRRDTRRFAEEERDMLLDNHRLYDLKKGIFLSADSEEEIFGHLDLDYLEPWERNA

SEQ ID NO: 4747 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaaacgcgcggcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgtactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggatgctgccaaatcctcgtcctgacaaactggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4748 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGMLPNPRPDKLDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4749 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4750 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4751 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4752 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4753 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactaccgttttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggatctggattatctggagccgtgggaacgcaacgcg

SEQ ID NO: 4754 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYRFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHSLYDLKKGIFLSADSEEEIFGHLDLDYLEPWERNA

SEQ ID NO: 4755 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4756 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4757 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 4758 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHSLYDLKKGIFLSADSEEEIFGHLDLDYLEPWERNA

SEQ ID NO: 4759 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtggtcactccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4760 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHSKCFAILKLYRPKVDNSAVGTSKKSDMAEVKDWKAVRVDLVVTPDEQFAYALLGWTGSGQFRRDTRRYAEEERDMLLDNHRLYDLKKGIFLSADSEEEIFGHLDLDYLEPWERNA

SEQ ID NO: 4761 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgatcgctccatttgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggagctggattatctggagccgtgggaacgcaacgcg

SEQ ID NO: 4762 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLELDYLEPWERNA

SEQ ID NO: 4763 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcactccagaagagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggatctggattatctggagccgtgggaacgcaacgcg

SEQ ID NO: 4764 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIREIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPEEQFAYALLGWTGSGQFRRDTRRYAEEERDMLLDNHRLYDLKKGIFLSADSEEEIFGHLDLDYLEPWERNA

SEQ ID NO: 4765 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagccaaacgcgcggcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcaactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcagctgccaagtcctaaacctgacaaactggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggcatgtttcgtcgcgatacgcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4766 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPSPKPDKLDNHQKCFAILKLYRPKVDNSAVGTSKKSDMAEVKDWKAVRVDLVIAPFEQFAYALLGWTGSGMFRRDTRRYAEEERDMLLDNHRLYDLKKGIFLSADSEEEIFGHLDLDYLEPWERNA

SEQ ID NO: 4767 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggatctggattatctggagccgtgggaacgcaacgcg

SEQ ID NO: 4768 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPDEQFAYALLGWTGSGQFRRDTRRYAEEERDMLLDNHRLYDLKKGIFLSADSEEEIFGHLDLDYLEPWERNA

SEQ ID NO: 4769 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4770 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4771 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcactccatttgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 4772 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPFEQFAYALLGWTGSGQFRRDTRRYAEEERDMLLDNHSLYDLKKGIFLSADSEEEIFGHLDLDYLEPWERNA

SEQ ID NO: 4773 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggagctggattggctggagccgtgggaacgcaacgcg

SEQ ID NO: 4774 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLELDWLEPWERNA

SEQ ID NO: 4775 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 4776 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHSLYDLKKGIFLSADSEEEIFGHLDLDYLEPWERNA

SEQ ID NO: 4777 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggagctggattatctggagccgtgggaacgcaacgcg

SEQ ID NO: 4778 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHSLYDLKKGIFLSADSEEEIFGHLELDYLEPWERNA

SEQ ID NO: 4779 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4780 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4781 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccacgcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4782 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVVAPREQFAYALLGWTGSGQFRRDTRRYAEEERDMLLDNHRLYDLKKGIFLSADSEEEIFGHLDLDYLEPWERNA

SEQ ID NO: 4783 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggatctggattatctggagccgtgggaacgcaacgcg

SEQ ID NO: 4784 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIREIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4785 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4786 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPDEQFAYALLGWTGSGQFRRDTRRYAEEERDMLLDNHRLYDLKKGIFLSADSEEEIFGHLDLDYLEPWERNA

SEQ ID NO: 4787 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtggtcgctccagaagagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggagctggattggctggagccgtgggaacgcaacgcg

SEQ ID NO: 4788 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHSKCFAILKLYRPKVDNSAVGTSKKSDMAEVKDWKAVRVDLVVAPEEQFAYALLGWTGSGQFRRDTRRYAEEERDMLLDNHRLYDLKKGIFLSADSEEEIFGHLELDWLEPWERNA

SEQ ID NO: 4789 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4790 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4791 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactaccgttttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagaaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccattcgaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 4792 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYRFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHSKCFAILKLYRPKVDNSAVGTSKKSDMAEVKDWKAVRVDLVIAPFEQFAYALLGWTGSGQFRRDTRRYAEEERDMLLDNHSLYDLKKGIFLSADSEEEIFGHLDLDYLEPWERNA

SEQ ID NO: 4793 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcactccatttgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggagctggattggctggagccgtgggaacgcaacgcg

SEQ ID NO: 4794 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPFEQFAYALLGWTGSGQFRRDTRRYAEEERDMLLDNHRLYDLKKGIFLSADSEEEIFGHLELDWLEPWERNA

SEQ ID NO: 4795 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggatctggattggctggagccgtgggaacgcaacgcg

SEQ ID NO: 4796 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDWLEPWERNA

SEQ ID NO: 4797 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4798 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4799 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4800 - protein, 394 aa, synthetic construct; identical to SEQ ID NO: 4780
  REGION 1..394: note = Variant of terminal deoxynucleotidyl transferase

SEQ ID NO: 4801 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcactccacgcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggagctggattggctggagccgtgggaacgcaacgcg

SEQ ID NO: 4802 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPREQFAYALLGWTGSGQFRRDTRRYAEEERDMLLDNHRLYDLKKGIFLSADSEEEIFGHLELDWLEPWERNA

SEQ ID NO: 4803 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatccgcgagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgatcactccagaagagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggatctggattggctggagccgtgggaacgcaacgcg

SEQ ID NO: 4804 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIREIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVITPEEQFAYALLGWTGSGQFRRDTRRYAEEERDMLLDNHRLYDLKKGIFLSADSEEEIFGHLDLDWLEPWERNA

SEQ ID NO: 4805 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgtctggaagcccgtcgcgtggcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcaactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcagctgccaaatcctcgtcctgacgctctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggcaactttcgtcgcgatacgcgtcgctttgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4806 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEARRVASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVATVSPDALVTIAGGFRRGKPMGHDVDLLITIPGRPEDDELLHKVVDLLKKQGLLLYEDIRESTFVEGQLPNPRPDALDNHQKCFAILKLYRPKVDNSAVGTSKKSDMAEVKDWKAVRVDLVIAPFEQFAYALLGWTGSGNFRRDTRRFAEEERDMLLDNHRLYDLKKGIFLSADSEEEIFGHLDLDYLEPWERNA

SEQ ID NO: 4807 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4808 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLNKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4809 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggagattgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4810 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEIERDMLLDNHRLYDLKKGIFLSADSEEEIFGHLDLDYLEPWERNA

SEQ ID NO: 4811 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggtgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4812 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLVSGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4813 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcattaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4814 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGIKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4815 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggagtatgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4816 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEYERDMLLDNHRLYDLKKGIFLSADSEEEIFGHLDLDYLEPWERNA

SEQ ID NO: 4817 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgcgtacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4818 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVRTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4819 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagatcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4820 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKITDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4821 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccattcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 4822 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHGLYDLKKGIFLSADSEEEIFGHLDLDYLEPWERNA

SEQ ID NO: 4823 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcggggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4824 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPRGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4825 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtgttggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4826 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVLDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4827 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccattagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4828 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAISVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4829 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcgccgaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4830 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACAEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4831 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacaggcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4832 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENRQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4833 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggagagggagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4834 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAERERDMLLDNHRLYDLKKGIFLSADSEEEIFGHLDLDYLEPWERNA

SEQ ID NO: 4835 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaaggtaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4836 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKGNLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4837 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggttgaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4838 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAVEERDMLLDNHRLYDLKKGIFLSADSEEEIFGHLDLDYLEPWERNA

SEQ ID NO: 4839 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacaggctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4840 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDRLDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4841 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcattttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4842 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSIFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4843 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagaaggacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4844 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEEKDMLLDNHRLYDLKKGIFLSADSEEEIFGHLDLDYLEPWERNA

SEQ ID NO: 4845 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtaccaggacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4846 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYQDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4847 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcagggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4848 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPQGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4849 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggcggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4850 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAAEERDMLLDNHRLYDLKKGIFLSADSEEEIFGHLDLDYLEPWERNA

SEQ ID NO: 4851 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcgtgggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4852 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAWEERDMLLDNHRLYDLKKGIFLSADSEEEIFGHLDLDYLEPWERNA

SEQ ID NO: 4853 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgtgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4854 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAVSVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4855 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcgtatgaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4856 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAYEERDMLLDNHRLYDLKKGIFLSADSEEEIFGHLDLDYLEPWERNA

SEQ ID NO: 4857 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggtggagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4858 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEVERDMLLDNHRLYDLKKGIFLSADSEEEIFGHLDLDYLEPWERNA

SEQ ID NO: 4859 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgttgttacgacctgaaaaagggcatctttctgagtgcggacagcgaagaagagattttcggtcatctggacctggattatctggagccgtgggaacgcaacgcg

SEQ ID NO: 4860 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRCYDLKKGIFLSADSEEEIFGHLDLDYLEPWERNA

SEQ ID NO: 4861 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagatgttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4862 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKMFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4863 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgaggctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4864 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQARLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4865 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgagattaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4866 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEITSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4867 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacggtcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4868 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENGQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4869 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacggtgacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4870 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYGDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4871 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagcggacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4872 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRERTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4873 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttcttctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4874 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVLLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4875 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccggtagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4876 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAGSVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4877 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttctgtattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4878 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFCILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4879 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagaagacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4880 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIREKTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4881 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccgtggccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4882 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTVAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4883 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgggtgcggacagcgaagaagagattttcggtcatctggacctggattatctggagccgtgggaacgcaacgcg

SEQ ID NO: 4884 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLGADSEEEIFGHLDLDYLEPWERNA

SEQ ID NO: 4885 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaaattccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4886 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQIPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4887 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcgcgggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4888 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAREERDMLLDNHRLYDLKKGIFLSADSEEEIFGHLDLDYLEPWERNA

SEQ ID NO: 4889 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgatggcggacagcgaagaagagattttcggtcatctggacctggattatctggagccgtgggaacgcaacgcg

SEQ ID NO: 4890 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLMADSEEEIFGHLDLDYLEPWERNA

SEQ ID NO: 4891 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgatgctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4892 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAMLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4893 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgacccttgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4894 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4895 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtagggaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4896 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSREEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4897 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacaatcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4898 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENNQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4899 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgttctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4900 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDVLDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4901 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcacggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4902 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACTEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4903 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctgcggagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4904 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLRSGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4905 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacattatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4906 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDIIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4907 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgctggaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4908 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVLEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4909 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagaaagccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4910 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKKAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4911 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttgataaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4912 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVDKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4913 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcatggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4914 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACMEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4915 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggacatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4916 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALDIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4917 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagccgtatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4918 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSRMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4919 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatatgcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4920 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDMRRYAEEERDMLLDNHRLYDLKKGIFLSADSEEEIFGHLDLDYLEPWERNA

SEQ ID NO: 4921 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagaggttttcggtcatctggacctggattatctggagccgtgggaacgcaacgcg

SEQ ID NO: 4922 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEVFGHLDLDYLEPWERNA

SEQ ID NO: 4923 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttcagctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4924 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVQLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4925 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgaaggcggacagcgaagaagagattttcggtcatctggacctggattatctggagccgtgggaacgcaacgcg

SEQ ID NO: 4926 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLKADSEEEIFGHLDLDYLEPWERNA

SEQ ID NO: 4927 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctattggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4928 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPIGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4929 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcagctctacgacctgaaaaagggcatctttctgagtgcggacagcgaagaagagattttcggtcatctggacctggattatctggagccgtgggaacgcaacgcg

SEQ ID NO: 4930 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHQLYDLKKGIFLSADSEEEIFGHLDLDYLEPWERNA

SEQ ID NO: 4931 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgaggtcctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4932 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDEVLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4933 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccctgaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4934 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMALNYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4935 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctgggtagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4936 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLGSGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4937 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctggttgcggacagcgaagaagagattttcggtcatctggacctggattatctggagccgtgggaacgcaacgcg

SEQ ID NO: 4938 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLVADSEEEIFGHLDLDYLEPWERNA

SEQ ID NO: 4939 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggagaggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4940 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVERQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4941 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgaggattacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4942 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAEDYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4943 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcagccagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4944 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFSQFAYALLGWTGSGQFRRDTRRYAEEERDMLLDNHRLYDLKKGIFLSADSEEEIFGHLDLDYLEPWERNA

SEQ ID NO: 4945 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatatccgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4946 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDIRRYAEEERDMLLDNHRLYDLKKGIFLSADSEEEIFGHLDLDYLEPWERNA

SEQ ID NO: 4947 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaaccttgggccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4948 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPWALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4949 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagttttgaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4950 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSFEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4951 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacaagctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4952 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDKLDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4953 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgaggcgacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4954 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIREATFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4955 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaactggcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4956 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENWQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4957 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagataacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4958 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKDNLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4959 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgaagcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4960 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTEALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4961 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgccatgaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4962 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACHEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4963 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaaggggacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4964 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKGDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4965 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccactgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4966 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTTAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4967 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtgaaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtatgtatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4968 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVKGQLPNPKPDALDNHQKCFAILKLYRPKVDNSAVGTSKKSDMAEVKDWKAVRVDLVIAPFEQFAYALLGWTGSGQFRRDTRMYAEEERDMLLDNHRLYDLKKGIFLSADSEEEIFGHLDLDYLEPWERNA

SEQ ID NO: 4969 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattttctggagccgtgggaacgcaacgcg

SEQ ID NO: 4970 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDFLEPWERNA

SEQ ID NO: 4971 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaataacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggtcgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4972 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNNERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4973 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtgttccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4974 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGVPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4975 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagatgccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4976 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEDADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4977 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgattctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4978 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLILYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4979 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttctcgattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4980 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFSILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4981 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtcgtaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4982 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRRKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4983 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgctgtatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4984 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERCMLLDNHRLYDLKKGIFLSADSEEEIFGHLDLDYLEPWERNA

SEQ ID NO: 4985 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgactgcggacagcgaagaagagattttcggtcatctggacctggattatctggagccgtgggaacgcaacgcg

SEQ ID NO: 4986 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLTADSEEEIFGHLDLDYLEPWERNA

SEQ ID NO: 4987 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggaagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4988 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGKLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4989 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcgcatgaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4990 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAHEERDMLLDNHRLYDLKKGIFLSADSEEEIFGHLDLDYLEPWERNA

SEQ ID NO: 4991 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtggctatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4992 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVAIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4993 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtaatagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4994 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRNSTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4995 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgcagaagggcatctttctgagtgcggacagcgaagaagagattttcggtcatctggacctggattatctggagccgtgggaacgcaacgcg

SEQ ID NO: 4996 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLQKGIFLSADSEEEIFGHLDLDYLEPWERNA

SEQ ID NO: 4997 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacgtgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 4998 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENVQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 4999 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacgttgattatctggagccgtgggaacgcaacgcg

SEQ ID NO: 5000 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDVDYLEPWERNA

SEQ ID NO: 5001 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctgagggccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5002 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5003 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctgaaggccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5004 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLKAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5005 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacgcgcatcgtctctacgacctgaaaaagggcatctttctgagtgcggacagcgaagaagagattttcggtcatctggacctggattatctggagccgtgggaacgcaacgcg

SEQ ID NO: 5006 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDAHRLYDLKKGIFLSADSEEEIFGHLDLDYLEPWERNA

SEQ ID NO: 5007 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcggtactggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5008 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAVLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5009 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcggggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5010 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACGEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5011 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggtagagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5012 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMVENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5013 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggagtgtgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5014 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAECERDMLLDNHRLYDLKKGIFLSADSEEEIFGHLDLDYLEPWERNA

SEQ ID NO: 5015 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccataagctctacgacctgaaaaagggcatctttctgagtgcggacagcgaagaagagattttcggtcatctggacctggattatctggagccgtgggaacgcaacgcg

SEQ ID NO: 5016 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHKLYDLKKGIFLSADSEEEIFGHLDLDYLEPWERNA

SEQ ID NO: 5017 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgcagctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5018 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQAQLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5019 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgcactacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5020 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLHYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5021 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccatgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5022 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAMSVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5023 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctggggccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5024 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPGALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5025 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctataccctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5026 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYTLLGWTGSGQFRRDTRRYAEEERDMLLDNHRLYDLKKGIFLSADSEEEIFGHLDLDYLEPWERNA

SEQ ID NO: 5027 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacgcgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5028 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENAQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5029 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtatcacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5030 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYHEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5031 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacagtgacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5032 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYSDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5033 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagcatacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5034 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIREHTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5035 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtaagtatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5036 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRKYAEEERDMLLDNHRLYDLKKGIFLSADSEEEIFGHLDLDYLEPWERNA

SEQ ID NO: 5037 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctgaatgccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5038 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLNAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5039 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcggaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5040 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNRKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5041 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagctgaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5042 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKLTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5043 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtatggaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5044 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSMEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5045 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatcttgctgagtgcggacagcgaagaagagattttcggtcatctggacctggattatctggagccgtgggaacgcaacgcg

SEQ ID NO: 5046 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHQKCFAILKLYRPKVDNSAVGTSKKSDMAEVKDWKAVRVDLVIAPFEQFAYALLGWTGSGQFRRDTRRYAEEERDMLLDNHRLYDLKKGILLSADSEEEIFGHLDLDYLEPWERNA

SEQ ID NO: 5047 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaaatttaaagagaacctgcaggcgtgcctggaagccaagcgcgccgcgagtgtcctgaaaagcctgccgttcgaggttaccagcatgaaagacatccaaggtctgccgtgcattaccgacgacgtacgtgacgtgatcgaagagatcatcgaagagggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctgaagatgacgagctgctccacaaagtggttgatctgctcaagaagcaaggtctgctgctgtacgaagacatccgtgagagcacgttcgtggaggggcaactgccaaatcctaaacctgacgccctggacaaccatggtaagtgcttcgccattctcaagctgtaccgtccgaaggtggataacagtgcggttgggacgagtaagaaaagtgacatggctgaggttaaggattggaaagcggttcgtgtggatctggtgattgcgccattcgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5048 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRDVIEEIIEEGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPEDDELLHKVVDLLKKQGLLLYEDIRESTFVEGQLPNPKPDALDNHGKCFAILKLYRPKVDNSAVGTSKKSDMAEVKDWKAVRVDLVIAPFEQFAYALLGWTGSGQFRRDTRRYAEEERDMLLDNHRLYDLKKGIFLSADSEEEIFGHLDLDYLEPWERNA

SEQ ID NO: 5049 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtgccacaacagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5050 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVPQQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5051 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5052 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5053 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagcgcctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtgccacaaatgctgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5054 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKRLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVPQMLPNPKPDALDNHQKCFAILKLYRPKVDNSAVGTSLKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5055 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5056 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLNKMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5057 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatgatgagctgctccacaaagtggttgatctgctcaagaagcaaggtctgctgctgtacgaagacatccgtgagagcacgttcgtggaggggcagctgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5058 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5059 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgaccatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtatgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgcactggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgcgccagatcatcagttcgccttcgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5060 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSMKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDHQFAFALLGWTGSGQFRRDTRRYAEEERDMLLDNHRLYDLKKGIFLSADSEEEIFGHLDLDYLEPWERNA

SEQ ID NO: 5061 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataaccgtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5062 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNRAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5063 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtcgcagcctgaagctgagcaagatgcagaaggcgggcttcctgtattacgaggatctggcgagcggtgttagtaaagaagaagccgatgccgttacggctatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtggaggggcagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5064 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASRSLKLSKMQKAGFLYYEDLASGVSKEEADAVTAIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5065 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggaaatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgcgtgcggacagcgaagaagagattttcggtcatctggacctggattatctggagccgtgggaacgcaacgcg

SEQ ID NO: 5066 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLRADSEEEIFGHLDLDYLEPWERNA

SEQ ID NO: 5067 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5068 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5069 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacggctatcgtgaaggaaacggtgcgcactgttagtccggatgcgctggtgaccatcgccggcggtttccgccgtggcaaacctatgggccacgacgttgacctgctgatcacgattccgaatcgtcctactgatgatgagctgctccacaaagtggttgatctgctcaagaagcaaggtctgctgctgtacgaagacatccgtgagagcacgttcgtggaggggatgctgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5070 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTAIVKETVRTVSPDALVTIAGGFRRGKPMGHDVDLLITIPNRPTDDELLHKVVDLLKKQGLLLYEDIRESTFVEGMLPNPKPDALDNHQKCFAILKLYRPKVDNSAVGTSLKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5071 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggaaatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgcgccagatgaacagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgcgtgcggacagcgaagaagagattttcggtcatctggacctggattatctggagccgtgggaacgcaacgcg

SEQ ID NO: 5072 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLRADSEEEIFGHLDLDYLEPWERNA

SEQ ID NO: 5073 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgttggttcgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5074 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRWFAEEERDMLLDNHRLYDLKKGIFLSADSEEEIFGHLDLDYLEPWERNA

SEQ ID NO: 5075 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaccaagatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataaccgtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5076 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLTKMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNRAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5077 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggatgctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5078 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGMLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5079 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagcctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5080 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5081 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5082 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5083 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgaccatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5084 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5085 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtggctttctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgcctctacgacctgaaaaagggcatctttctgagtgcggacagcgaagaagagattttcggtcatctggacctggattatctggagccgtgggaacgcaacgcg

SEQ ID NO: 5086 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASGFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5087 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagcctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtgccagggcagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5088 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVPGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5089 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatgatgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5090 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5091 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5092 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5093 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacggctatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggatgctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5094 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTAIVKETVRTVSPDALVTIAGGFRRGKPMGHDVDLLITIPGRPTDDELLHKVVDLLKKQGLLLYEDIRESTFVEGMLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5095 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagcgcctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctactgatgatgagctgctccacaaagtggttgatctgctcaagaagcaaggtctgctgctgtacgaagacatccgtgagagcacgttcgtggaggggcagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgcctctacgacctgaaaaagggcatctttctgagtgcggacagcgaagaagagattttcggtcatctggacctggattatctggagccgtgggaacgcaacgcg

SEQ ID NO: 5096 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKRLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5097 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtcgctttctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgcctctacgacctgaaaaagggcatctttctgagtgcggacagcgaagaagagattttcggtcatctggacctggattatctggagccgtgggaacgcaacgcg

SEQ ID NO: 5098 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASRFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5099 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5100 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5101 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtgccagggcagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5102 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVPGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5103 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtggagcaacagctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5104 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEQQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5105 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgaccatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtggcgcgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgcgccagatcatcagttcgccttcgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5106 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVARVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDHQFAFALLGWTGSGQFRRDTRRYAEEERDMLLDNHRLYDLKKGIFLSADSEEEIFGHLDLDYLEPWERNA

SEQ ID NO: 5107 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5108 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5109 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagtagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5110 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEVAKASKSLKLSKMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5111 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctgatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5112 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5113 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtggcagcctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctactgatccggagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5114 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASGSLKLSKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5115 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacggctatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggatgctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5116 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTAIVKETVRTVSPDALVTIAGGFRRGKPMGHDVDLLITIPGRPTDDELLHKVVDLLKKQGLLLYEDIRESTFVEGMLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5117 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgaccatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacaaactggacaaccattcgaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctacgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5118 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDKLDNHSKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5119 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagaagcaaaggccagtaagagtctgaagctgagccgcatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgttggtacgcgtcggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5120 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSRMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRWYASEERDMLLDNHRLYDLKKGIFLSADSEEEIFGHLDLDYLEPWERNA

SEQ ID NO: 5121 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagtttctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctactgatgatgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5122 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKFLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5123 - DNA, 1182 bp, synthetic construct; identical to SEQ ID NO: 5053
  misc_feature 1..1182: note = Variant of terminal deoxynucleotidyl transferase
  source 1..1182: mol_type = other DNA

SEQ ID NO: 5124 - protein, 394 aa, synthetic construct; identical to SEQ ID NO: 5054
  REGION 1..394: note = Variant of terminal deoxynucleotidyl transferase

SEQ ID NO: 5125 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgaccatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgcgtgcggacagcgaagaagagattttcggtcatctggacctggattatctggagccgtgggaacgcaacgcg

SEQ ID NO: 5126 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLRADSEEEIFGHLDLDYLEPWERNA

SEQ ID NO: 5127 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgcttcgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5128 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRFAEEERDMLLDNHRLYDLKKGIFLSADSEEEIFGHLDLDYLEPWERNA

SEQ ID NO: 5129 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg
